United States Patent 7,745,391 (HUMAN THROMBOSPONDIN POLYPEPTIDE) - sequence listing, part 186

SEQ ID NO: 450695 - DNA, 3253 bp, Homo sapiens
agcggggcttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattgggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcactttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgcatc

SEQ ID NO: 450696 - DNA, 2894 bp, Homo sapiens
ttccattggttgctggctagtccactgtcacagagtgccctttgatgcctactcctctctcttgctctgtgaagaggatgtcagtatagcacagatcttggtcatagcgctttctgatttccgggtgagtctgtccaattaaacaatccaccatacatgtcttgccatgctggagatgtccacaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagca

SEQ ID NO: 450697 - DNA, 2643 bp, Homo sapiens
agcggggcttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagca

SEQ ID NO: 450698 - DNA, 1059 bp, Homo sapiens
aacttacggctagtagaggctcggtgtgaatcggccgaggctgcaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttcctttaaaaaactcgtgccgaattcggcacgaggagtttttttttttaatttgtctccaataagcaatgtcttctgcccatccagcatgggaagtgggtcccacgtgaagggggcccaccacccactttgggagctgaaggcagagactcgggagcactaccggctcagactccccctacgctgggtgctcgtgc

SEQ ID NO: 450699 - DNA, 1080 bp, Homo sapiens
ccctctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcaggtgcgttgcagcctagacgggtcttactgtgagccgagcagcctctgggacctgtctgcttcccctaccccttgcaaagaagccggagcccagagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttta

SEQ ID NO: 450700 - DNA, 670 bp, Homo sapiens
ggcggctgggaggggcggggcggatgcggggacagcggcctggctaactcctgccaggcagtgcccttcccggagcgtgccctcgccgctggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttta

SEQ ID NO: 450701 - DNA, 1032 bp, Homo sapiens
ggcggctgggaggggcggggcggatgcggggacagcggcctggctaactcctgccaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttcctttagactcttaaaaaaaaacaccggcctatcggtggacaggccgacggcggcaaggtcggccgttgaagggagcgggccagaggaataacgccgaatcgccaaccccccgtacaccaacaccacacctcaaaaccttacacgtcacgcatctcc

SEQ ID NO: 450702 - DNA, 707 bp, Homo sapiens
aacttacggctagtagaggctcggtgtgaatcggccgaggctgcaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcgtgggggacggcggctgccagagtggacgcccggggtcaagcgcaacggcttcccggtggctctggctcgcgcggtctccaacgagatcgtgcgcttccccacagagagagcgt

SEQ ID NO: 450703 - DNA, 469 bp, Homo sapiens
aacttacggctagtagaggctcggtgtgaatcggccgaggctgcaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacaggggtcagcagagcttcagaggtggccccacctgagcccccacccgggagcagtgtcctgtgctttctgcatgcttagagcatgttcttggaacatggaattttataagctgaataaagtttttgacttccttta

SEQ ID NO: 450704 - DNA, 870 bp, Homo sapiens
aacttacggctagtagaggctcggtgtgaatcggccgaggctgcaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttta

SEQ ID NO: 450705 - DNA, 881 bp, Homo sapiens
ggcggctgggaggggcggggcggatgcggggacagcggcctggctaactcctgccaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttta

SEQ ID NO: 450706 - DNA, 987 bp, Homo sapiens
ccctctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcagagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttta

SEQ ID NO: 450707 - DNA, 905 bp, Homo sapiens
  misc_feature (886)..(886): n is a, c, g, or t
  misc_feature (888)..(888): n is a, c, g, or t
  misc_feature (895)..(895): n is a, c, g, or t
aacttacggctagtagaggctcggtgtgaatcggccgaggctgcaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcgcgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttcctttaaaaaaaaaaaaacaananaaaaaanaaagaggcgg

SEQ ID NO: 450708 - DNA, 2274 bp, Homo sapiens
  misc_feature (2010)..(2010): n is a, c, g, or t
  misc_feature (2014)..(2014): n is a, c, g, or t
  misc_feature (2016)..(2016): n is a, c, g, or t
gtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtggaaaaaaaaaaaaaanaaananaaaaaaaaaaacaaaaaaaaagcagggggcgccggcagaaaagataccactcgaggggggcaaaaaaataggcacaccagcaagtgtggacgaaaaaggggggccaccactgagggacgccaaaaagacgagcgagcggcacggaattaaacggggctacggacgaacagcgagacaggatatcggggaggacgccaacaaccaggaggggacagatggaacaacccacagaatagcgcagggaacaaagaaggtaag

SEQ ID NO: 450709 - DNA, 1928 bp, Homo sapiens
  misc_feature (1664)..(1664): n is a, c, g, or t
  misc_feature (1668)..(1668): n is a, c, g, or t
  misc_feature (1670)..(1670): n is a, c, g, or t
gtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagaaaaaaaaaaaaanaaananaaaaaaaaaaacaaaaaaaaagcagggggcgccggcagaaaagataccactcgaggggggcaaaaaaataggcacaccagcaagtgtggacgaaaaaggggggccaccactgagggacgccaaaaagacgagcgagcggcacggaattaaacggggctacggacgaacagcgagacaggatatcggggaggacgccaacaaccaggaggggacagatggaacaacccacagaatagcgcagggaacaaagaaggtaag

SEQ ID NO: 450710 - DNA, 2045 bp, Homo sapiens
attgcaatagagagagtttaatccacatacatccagctaaatgggagatgggagttttattacttgaatcagcctccctgaaaattcagaggctagggttattcaagaacagtttggtgggcaggagggctagggaatgggtgccttgctgcaatcctggagctgtggaaaacagttgctgagtcagcttctgggtggggaccatagagtcgctagtctgggtggagtcatccagttgtcagatatgcaaaaagcctaaaaagacatgttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtgga

SEQ ID NO: 450711 - DNA, 1236 bp, Homo sapiens
gtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtgga

SEQ ID NO: 450712 - DNA, 958 bp, Homo sapiens
tcgcggttcctggaagctaaagatgagctggttacatgaaaattaacctttggaatctgtcagtcccagtcttgaatgatcatacattctggctggtagataaaaccaattcctaacaaagagtctttgaaatgtttacaaagctctacatcaacaaaccaaaatgcaagataatacaagaccgggtcaggcatagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtgga

SEQ ID NO: 450713 - DNA, 902 bp, Homo sapiens
tcgcggttcctggaagctaaagatgagctggttacatgaaaattaacctttggaatctgtcagtcccagtcttgaatgatcatacattctggctggtagataaaaccaattcctaacaaagagtctttgaaatgtttacaaagctctacatcaacaaaccaaaatgcaagataatacaagaccgggtcaggcatagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtgga

SEQ ID NO: 450714 - DNA, 1996 bp, Homo sapiens
gtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtgga

SEQ ID NO: 450715 - DNA, 2087 bp, Homo sapiens
gtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccaggtgaagggggccccgggccaactaggggcgaaactctagggctgccctgcctgggaggaatttcacgttgcctccgtttatccgcccgcagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtgga

SEQ ID NO: 450716 - DNA, 1879 bp, Homo sapiens
  misc_feature (46)..(46): n is a, c, g, or t
  misc_feature (48)..(48): n is a, c, g, or t
  misc_feature (59)..(59): n is a, c, g, or t
  misc_feature (61)..(61): n is a, c, g, or t
  misc_feature (109)..(109): n is a, c, g, or t
  misc_feature (115)..(115): n is a, c, g, or t
  misc_feature (152)..(152): n is a, c, g, or t
cgtactgcgctggatatctggcaggtctgaatgtgaccagatagtntncctggacagcngnccaagcttcaacagcacagaggacactccaaatggtgcgtgtccccanaagggncctggacctgcgtgggtgacatgaatcggaaccaggnagaggagcaacggggtgggggcacactgtgtgcccagctgccagccctctggaaagccttccagccgctggtgaagaactaccagccctgtaatggcatggccagggagcccagcagagcttataggatctaacccttatggcaaagtgctgggattacaggcgtgagccactgcgcccggcctcccctaatgccttcttttggtccaggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtgga

SEQ ID NO: 450717 - DNA, 1999 bp, Homo sapiens
  misc_feature (1)..(1): n is a, c, g, or t
  misc_feature (14)..(14): n is a, c, g, or t
nagggcctttgggnagctcaaggatccttaattaatttaatcccccccccccccccccccgattccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtcaaccgaatgtctcggccttttactcagacaagtagcatctcattaaacccattcatttagcattcattcagctggacc

SEQ ID NO: 450718 - DNA, 1670 bp, Homo sapiens
  misc_feature (1)..(1): n is a, c, g, or t
  misc_feature (14)..(14): n is a, c, g, or t
nagggcctttgggnagctcaaggatccttaattaatttaatcccccccccccccccccccgattccgggctcgaaggctgtgcggtctgccaggagctgcggccccgtccggcccgggctggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtca

SEQ ID NO: 450719 - DNA, 1958 bp, Homo sapiens
  misc_feature (1)..(1): n is a, c, g, or t
  misc_feature (14)..(14): n is a, c, g, or t
nagggcctttgggnagctcaaggatccttaattaatttaatcccccccccccccccccccgattccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacagggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtcaaccgaatgtctcggccttttactcagacaagtagcatctcattaaacccattcatttagcattcattcagctggacc

SEQ ID NO: 450720 - DNA, 867 bp, Homo sapiens
aaatgttcaggctgggcgtggtggctcacgcctgtaatcccagcactttgggaggccgaggtgggcagatcactggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtcaaccgaatgtctcggccttttactcagacaagtagcatctcattaaacccattcatttagcattcattcagctggacc

SEQ ID NO: 450721 - DNA, 576 bp, Homo sapiens
  misc_feature (1)..(1): n is a, c, g, or t
  misc_feature (14)..(14): n is a, c, g, or t
nagggcctttgggnagctcaaggatccttaattaatttaatcccccccccccccccccccgattccgggctcgaaggctgtgcggtctgccaggagctgcggccccgtccggcccgggctggcatgggttggaattggagcctatcccccaacccgaaggctaacagcatcatgtggttactaactgttcccgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccact

SEQ ID NO: 450722 - DNA, 935 bp, Homo sapiens
  misc_feature (1)..(1): n is a, c, g, or t
  misc_feature (14)..(14): n is a, c, g, or t
  misc_feature (333)..(333): n is a, c, g, or t
  misc_feature (338)..(338): n is a, c, g, or t
  misc_feature (341)..(341): n is a, c, g, or t
  misc_feature (349)..(349): n is a, c, g, or t
  misc_feature (357)..(357): n is a, c, g, or t
  misc_feature (373)..(373): n is a, c, g, or t
  misc_feature (375)..(375): n is a, c, g, or t
  misc_feature (393)..(393): n is a, c, g, or t
  misc_feature (399)..(399): n is a, c, g, or t
  misc_feature (402)..(402): n is a, c, g, or t
  misc_feature (406)..(407): n is a, c, g, or t
  misc_feature (437)..(437): n is a, c, g, or t
  misc_feature (443)..(443): n is a, c, g, or t
  misc_feature (445)..(446): n is a, c, g, or t
  misc_feature (450)..(450): n is a, c, g, or t
  misc_feature (454)..(454): n is a, c, g, or t
  misc_feature (460)..(460): n is a, c, g, or t
  misc_feature (472)..(472): n is a, c, g, or t
  misc_feature (484)..(484): n is a, c, g, or t
  misc_feature (491)..(491): n is a, c, g, or t
  misc_feature (513)..(513): n is a, c, g, or t
  misc_feature (518)..(518): n is a, c, g, or t
  misc_feature (529)..(529): n is a, c, g, or t
  misc_feature (552)..(552): n is a, c, g, or t
  misc_feature (556)..(557): n is a, c, g, or t
  misc_feature (561)..(561): n is a, c, g, or t
  misc_feature (605)..(606): n is a, c, g, or t
  misc_feature (670)..(670): n is a, c, g, or t
  misc_feature (675)..(675): n is a, c, g, or t
  misc_feature (681)..(681): n is a, c, g, or t
  misc_feature (693)..(693): n is a, c, g, or t
  misc_feature (718)..(718): n is a, c, g, or t
  misc_feature (724)..(724): n is a, c, g, or t
  misc_feature (740)..(740): n is a, c, g, or t
  misc_feature (776)..(776): n is a, c, g, or t
  misc_feature (815)..(816): n is a, c, g, or t
  misc_feature (819)..(819): n is a, c, g, or t
  misc_feature (841)..(841): n is a, c, g, or t
  misc_feature (857)..(857): n is a, c, g, or t
  misc_feature (872)..(872): n is a, c, g, or t
  misc_feature (888)..(888): n is a, c, g, or t
nagggcctttgggnagctcaaggatccttaattaatttaatcccccccccccccccccccgattccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggnacaanaanacaaattnacaacatncacaattacattaatntnctttcaaaatcatatttnctacancanccannccagcattcttaaaaacaatctaaacttanataaantnnaagngcancgcganataaagctcagnaaaaaataaaanaataaanagctttaaaaaatattatattnttgcngcgctaagcanatatttaaagcttaagcagcganttgnncgcntaaaaattatataagcagcgctgcaaaaagctgcaataagcaannggcatgctttaaagcgcgcgaaatatagcttaaagctgcataagctaaaaaaaagcatgctggncaaantgctangctgcagcgcanatttacgcagcatttaaatttgtgngcttantataaagaatgccttntaatgcgaaaaaagcagctaataattatgctgcagngcgcgcagaatgaatttaaaaaaggcgtaggcgggcgcnncgnaggcaatttatatagcatgcanaatatataaaaaatgngcaaataaatttatngcaaaagccgcaatgnccaatgctatatggcttttagcaataaaaaagcaggcaaaagctatg

SEQ ID NO: 450723 - DNA, 1477 bp, Homo sapiens
  misc_feature (1)..(1): n is a, c, g, or t
  misc_feature (14)..(14): n is a, c, g, or t
nagggcctttgggnagctcaaggatccttaattaatttaatcccccccccccccccccccgattccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccact

SEQ ID NO: 450724 - DNA, 1922 bp, Homo sapiens
  misc_feature (1)..(1): n is a, c, g, or t
  misc_feature (14)..(14): n is a, c, g, or t
nagggcctttgggnagctcaaggatccttaattaatttaatcccccccccccccccccccgattccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtca

SEQ ID NO: 450725 - DNA, 1944 bp, Homo sapiens
gcaggctgtacgctcggagtacgggatgtgcggtctgcaggagctgcggcccgtcggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtcaaccgaatgtctcggccttttactcagacaagtagcatctcattaaacccattcatttagcattcattcagctggacc

SEQ ID NO: 450726 - DNA, 580 bp, Homo sapiens
  misc_feature (125)..(125): n is a, c, g, or t
tctaaggaagtcagcccgcctctcctctagtggtagaaaacttgaggtacaggcagagaaaagggaacaagaacaggttaggtgccttctgcagccacttcacatttcccggagtaggacagatnacaaagagctcagatcaaaacaacaaaggtccaaggcttagtttatcaagctcccatatacaagaaaaaatatcaaaaactggagaggactgttttcaaagcaacatcaaggcctgataaccagggtcacatatattcgtccctgttccttactctctgcacctcacccgttgcccaaatcagtccgctttgtccccagtctttcccttcccgaccttctcctttccaatttcagcatggatgcggtagtctgagaccaccaaggcagctgccaaacggatgccctgctgctccccttccaacccactgtgcgcacagctgtcaaggcaatcctcccaagcagacctcactcttgcccaaaacttcctcagcccctcaactctgaactgagaacaaaattagagactgcttggtctggcacattccaagcccaatagtcctgcatatggctgatg

SEQ ID NO: 450727 - DNA, 443 bp, Homo sapiens
tcgcctctgccacccctgagacagcaggaccaaccctcccttcctcctcctcagcctgctctacgtgaagatgatgaggatgaagacctttatgacgatccacttccacttaatgaaaagtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaa

SEQ ID NO: 450728 - DNA, 994 bp, Homo sapiens
gggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggaaaaaaacacacacacgaaccaatgaagaaaaaaaaaaagacaacaaaagaaagctgagagagacgacaacaaaaatgaaagaaaaagaaaacgaaaaccaagaatagaaaatctagtaatcaacgccaatatcaaagataaagagacgacaaagagaaatgctaatcatagaactaggaggggaagctgcgtatacctagccataaagagaagaaaagaaaatctagaggacaaatgaaaggaaaatatggcaggcagcgaaacgaagagaactaaaaagatagctactcaatgagacaggagcatatctagccaggcagctaaaaatgcgatggaagacgactgccggagaaataccccggcgatgcatgaccgaagaacagcagaggaccagcggtgttgaatggtcaagatgcatgtgtatgaattcacggcgaaatgaagcgaaaaaatcgacaagggagagaaaatccccaaggtaaccaggagagaaagagagagaggggaagagtatcggagtactagattatccgagaagatgtagataagtggatataaagtgcgtggcaccgattctgtcaaatggcaccggccgtggccgaaaatgatgatactgttggaaagcggcgagcgcacgatgagatgaagaggtcccccgagaaaactcccgagtgcgagttagaagaggcccccgagatacggaagagggagaacgagggagatgcgggaccccgagaatggttgaatggcgcgaaaaagatggcgaaatggcagggttctcggcagaggtgacaacgccgtggctagggatacccgtccggacagcgtaggtcccagcgccaacaatg

SEQ ID NO: 450729 - DNA, 678 bp, Homo sapiens
gttgaatacttatatcaaaagaaaccttggtgctgaggtaaagtttctgtaggaaaatcagaagaaatacttgattctttccctatatttaccagtctttaatgggttgattctctagtttctgtttgttttgtgttgctataacagagtacctgagactggataatttataaggaacagagatttatttcttacagtctggaggctgggaaatccaaggttgagggctgtgtctggtgagggtggaaggtggaaggactggagagtgtgcatgaaggggactgaactccttcttctaccaggagcccgctcaccacctgtgagggcagccagaatccttcatgaggcagaaccctcatgacctcagtacctctgaaggccccgccctgtctctcaacactgttgcattgactattcagtttccaacagaggaactttgggggagcacattcaaaccatagtacctggtgaatgaaaactttgccattgatttgatagcagagcagcccgtgagcgaggtggagactcgggtgatagcgtgcgatggcggcgggggagctcttggccacccaaaagtgtatataaacttggacaaggaacagtggacgcccggggttcccgagcatctgtgagcaatttcccggggaacgtagcacgtgaagttgttgttttttgcca

SEQ ID NO: 450730 - DNA, 236 bp, Homo sapiens
ttaatatataagatttaaataaattttccccatattgcaagcaccctaacagttctggatggggttcttcctttcttaaaatcttaattgtgtctatttctgacttgtttccccctgaaatacataacattgtagccgtagttctggtttgcatataaatggaagtgatcttttttaaaattcttgtcccttattctcctgagactctcagatttaagtaaatcatatcaactttt

SEQ ID NO: 450731 - DNA, 1541 bp, Homo sapiens
cttagttcagggttacaagacttctgctgaaccagtgagctgacctctctatttccttccccacactgaaaatcctgatttttcaataataatttcatttgctttggaagcggttttattcttaaggtgtgtcctgttagaaatgttcctgttactctcttaaagtgttgggaattccttaggtccatttgtctcttttaaaagtttagttttctaactttgaaaaatataaaatatagtctcagtcagatttataaaacttggaagaaagtctaacgatcgtgctcgcgtcctccttcctttccacctcacagtagtaactgttcagtgctttcttctttggatttcatgtaaatcagtgaatatgtaggcggacccctggtattccccacatggatgagtggaagcttcctgtccacttacccactgcctggcatctccacgtagtcctgtgtcctccttcaccccatcgcggtattatggagacacttttttcattccgttttgatagtaactgaaagcatcagcacacaagcaggacgtgaagttaccagagtctttcccgcacatgcctatgagtcataaatgaccaggtggaagacacagtggatgaggagacccagtgtacggtagcagcaaacaagagaaaacacttaggaacaacctaaccggcattcaggacctctgtggcccaaggggaaagccggaaggacattgttggtctaacggattgcagagctactggcatttttggcattttagataaatctattccatcggtatcatgtttactgaggtggataactgcatggaggttctgtgagagaatgttcttatgaaacgcacatgggagcctgtgacagacaggcccgagcaatacaaatgtcctcaggtgggacagaacgatgtggtggagagaagagggcgtggcagagcccacggggcacgtgtcagcatttgctgggtccacggggacagaagggaaaggctctgtgctgctgggattcttgcagtgcctctccgcgtttggaactttattccagtgaaaagtagatgtgtgtgtaggccctgaatttaataaggtctacaatgataatagttaaatgaagcatgcaccatagattcgtgctgatggtacatgaatttgtgtgtggtgggttaaattgtagttagcaagtttgtgtatttgtttacgtaagtctttcttcttgttccaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaa

SEQ ID NO: 450732 - DNA, 619 bp, Homo sapiens
gggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtatctcgctaaaaatgcccctgattacaccgagtactgtgcacttgtttgacttttcatcaatggcctaaaagtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaa

SEQ ID NO: 450733 - DNA, 627 bp, Homo sapiens
gggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaaaaaataaagcaaaataaaacctaacaaacaaaaagagccccaaggaaccaaaaaaaaactaaaaaatagaaattccttgtg

SEQ ID NO: 450734 - DNA, 1057 bp, Homo sapiens
  misc_feature (560)..(560): n is a, c, g, or t
gggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaaaaaaaaaaaaaaanaaaaaaaaaaaaaaaaaaaaatttttgggggcgcttgggccttggaaaagtttttaagacccatccggttgggcggcgcgggggccaaggaagggaacaggtgagacctgtgggcaacagcgcgggaccccacagggaaacccggggccctggaccacgggcacggagatccccaccaataaaacacaacggccgggggggggcaaaaacgagaagaggttgagagaacaaattccaaagtgtgggagcgtccaggagggacaaatcacgcgggactcatttaacccaggagggccaaagcgaggaggccgaaaatccaattataggccccagtctcggggttaaaacgaaaacagaaacaacaacaaacaggaagaagacgaacgagagaaggagaaagacaaggaaaaagagaaacagagagacagaaaaagagacgaggagacaaaaaggaagggaagaaaaagagaacgagcggaaagagaaaaaacaaaagt

SEQ ID NO: 450735 - DNA, 791 bp, Homo sapiens
gttgaatacttatatcaaaagaaaccttggtgctgaggtaaagtttctgtaggaaaatcagaagaaatacttgattctttccctatatttaccagtctttaatgggttgattctctagtttctgtttgttttgtgttgctataacagagtacctgagactggataatttataaggaacagagatttatttcttacagtctggaggctgggaaatccaaggttgagggctgtgtctggtgagggtggaaggtggaaggactggagagtgtgcatgaaggggactgaactccttcttctaccaggagcccgctcaccacctgtgagggcagccagaatccttcatgaggcagaaccctcatgacctcagtacctctgaaggccccgccctgtctctcaacactgttgcattgactattcagtttccaacagaggaactttgggggagcacattcaaaccatagtacctggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaa

SEQ ID NO: 450736 - DNA, 417 bp, Homo sapiens
ggccgtaaaagtcacacatggtctttttgtttttttccaggtttatgatgataaagactacaggagaattcggtttgtaggtcgtcagaaagaggtgagtaaaaaatctagtgaagagaggtaagctttcctaaaacttttatgtaaccaacaagaaataaaaattaatatataagatttaaataaattttccccatattgcaagcaccctaacagttctggatggggttcttcctttcttaaaatcttaattgtgtctatttctgacttgtttccccctgaaatacataacattgtagccgtagttctggtttgcatataaatggaagtgatcttttttaaaattcttgtcccttattctcctgagactctcagatttaagtaaatcatatcaacttttaaaaaattattctttta

SEQ ID NO: 450737 - DNA, 546 bp, Homo sapiens
gggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaa

SEQ ID NO: 450738 - DNA, 1054 bp, Homo sapiens
gggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaatttatatctgtgtgaggctggattttctttgcctactccaaccaaagcgacacatcacagcagactggatgcagaagcgtgcgtgggaatgcagctgttttccatggaaccagacgctacagagactgcaacgtgtaaaacactgccattcttttcattcctttgaataatttttttaaaatttgctatttaacacgtaatagttttttattttaaaatgaattaatacttttttttttttgaaaaggaatctagctctgtcacccaggctggagtgcagtggccccatttcagttcactgcaacctccacctccaagtttcaagtgatcctcctgctccagcctctcaagtagctgggattacagggcaccaccgtgcccacctaatttttgtatttttagtagagacagcgttgaccatgttggtcaggctggtcccgaactcctgacctcgtgatccacctgcctcggtctcccagagtgctgagattacaggcgtgagccaccg

SEQ ID NO: 450739 - DNA, 671 bp, Homo sapiens
  misc_feature (593)..(593): n is a, c, g, or t
  misc_feature (637)..(637): n is a, c, g, or t
  misc_feature (639)..(639): n is a, c, g, or t
  misc_feature (642)..(642): n is a, c, g, or t
  misc_feature (653)..(654): n is a, c, g, or t
  misc_feature (659)..(659): n is a, c, g, or t
  misc_feature (665)..(665): n is a, c, g, or t
gggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaaaaaaaaaaaaaaaaaaaaaaaaaaaaaaaaaaaaaaaaaaaaaaaanaaaaaaaaaaaaaaaaaaaaaaaggggggggggggcaaaaaaantnccncgggggggccnnaagtntagagncacccg

SEQ ID NO: 450740 - DNA, 638 bp, Homo sapiens
  misc_feature (560)..(560): n is a, c, g, or t
  misc_feature (604)..(604): n is a, c, g, or t
  misc_feature (606)..(606): n is a, c, g, or t
  misc_feature (609)..(609): n is a, c, g, or t
  misc_feature (620)..(621): n is a, c, g, or t
  misc_feature (626)..(626): n is a, c, g, or t
  misc_feature (632)..(632): n is a, c, g, or t
gggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgaaaaaaaaaaaaaaaaanaaaaaaaaaaaaaaaaaaaaaaaggggggggggggcaaaaaaantnccncgggggggccnnaagtntagagncacccg

SEQ ID NO: 450741 - DNA, 641 bp, Homo sapiens
gggacgttgcgccgggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttacttttttttttttttaaaagctatgttgttagcacacagaacacttcattgttgtttttgggggaaggggcatatgtcactaatagaatgtctccaaagctggattgatgtggagaaaacacctttccct

SEQ ID NO: 450742 - DNA, 5567 bp, Homo sapiens
  misc_feature (5388)..(5388): n is a, c, g, or t
gcagctgggagtagtactgccggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcatcggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggaggtgttctttatacattttcctacagggcttctctgtggagaaatccgaaaagcatatgtagaatttgtcaatgtcagcaaatgtccacttactggattgaaggttgtttctaaacgtccagagttctttactttcggtggtaatactgctgttctaacaccactaagtccctcagcttctgagaattgtagtgcttacaagactgttgtgacagatgctacctctgtgtgtacagcactcatatcatcagcttcttctgtagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtaaaaaaaaaaaaaaaaaaaccaaaaaaactttgggggccgcctgggcctcgaaaaggtttttaaaacccttcggtggggggcgggggcccacagaggtacactgtgaccctgggnccacaaggcgtgtcccacaagagaacaccggggacaagagcaaggccgcgggatttttctcaccagtaaaaaaaaacggcgggggggaccccaggggttcctgaacaaattcacaaaggggccaggaggacataaggggactctacaccaggagcgccaaaggaagcggatataagtcc

SEQ ID NO: 450743 - DNA, 6041 bp, Homo sapiens
gcagctgggagtagtactgccggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcatcggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggaggtgttctttatacattttcctacagggcttctctgtggagaaatccgaaaagcatatgtagaatttgtcaatgtcagcaaatgtccacttactggattgaaggttgtttctaaacgtccagagttctttactttcggtggtaatactgctgttctaacaccactaagtccctcagcttctgagaattgtagtgcttacaagactgttgtgacagatgctacctctgtgtgtacagcactcatatcatcagcttcttctgtagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtatagcgtattagtatctgttgattagaaagtctggtttcaaaatatttttttattcagagaatgggcatttggacataagaaatttcaattcagccctgctgcagatagagaaatgggagcaaggttgtttcaatgaatatctcttgtcattggagaaggagggaagacagggtgtaggagtgggtggcagggagtacaagagccagggtcagtcaagtctggagcagatggggtccttgtgccattgacagctaccatggtttgttccagtctcaatctcggcactaatcggagcagactgcaccaaagtggggagagatcaaaagaccccgttttcagactgaagattccaaacctgtacttggaacaactcttcttgagagatgggtggctagtctgtgtgcctctctgcaactgctgcttatgcttctggatcttaagtgggtctctggcttttcagctccttccactctgtgtcttagcaggtgtgggacaagttggagaggaaggtcacattctaaggacactcatttccttcttgagagtttagggccatgggcttataaaaagtctgaggaggaaagacaagaatgaggaggcataatcacagtggtatctcatatttaaaccactcagctgaatattaaattgaaccgattgttaaacagacactaataaaaaaattaaactatataaacctacaactgaatatattaaaaataaaggtaataaagcactcaaaattacttcctgaatattactcagga

SEQ ID NO: 450744 - DNA, 5204 bp, Homo sapiens
  misc_feature (5118)..(5119): n is a, c, g, or t
  misc_feature (5204)..(5204): n is a, c, g, or t
gcagctgggagtagtactgccggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcatcggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggaggtgttctttatacattttcctacagggcttctctgtggagaaatccgaaaagcatatgtagaatttgtcaatgtcagcaaatgtccacttactggattgaaggttgtttctaaacgtccagagttctttactttcggtggtaatactgctgttctaacaccactaagtccctcagcttctgagaattgtagtgcttacaagactgttgtgacagatgctacctctgtgtgtacagcactcatatcatcagcttcttctgtagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaaaaacttgagactagctcgtgccgatattttttagcagttctaatggtgcccatttatcctgacctaaccagttatttaaataattttttaaaccaccacgnntaataaatggcatgtgaactgatctgttggtaactggaagaaaactcagcatctgtatttatacaataaaattgattagtttttn

SEQ ID NO: 450745 - DNA, 1870 bp, Homo sapiens
  misc_feature (1691)..(1691): n is a, c, g, or t
tttgatagaaaaacaaatgtcagtctaggccaagttctcaaaattaagtaatttttaataagcacaaagacaacagtattagttgttggcattttcatggtttactttttcttcattgatctaagttgagattttgtttttcattttgtgaaatatctagaaacattttagttgtttttagaagattaataaatgaaaataaaatagttctgtgaatgtatatattctgatatttaatattgtcattgtattaatatattttttatttacaatataatttgtcttgagtgattttggaacttgagctttttccttcttgaatctgattgtttttaaggagcttatgctctgttacatagtcttaagtgttattttcaggaaaattgcttttaagaagaaaaaaatatataacttttttgtttatttttcttccatagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtaaaaaaaaaaaaaaaaaaaccaaaaaaactttgggggccgcctgggcctcgaaaaggtttttaaaacccttcggtggggggcgggggcccacagaggtacactgtgaccctgggnccacaaggcgtgtcccacaagagaacaccggggacaagagcaaggccgcgggatttttctcaccagtaaaaaaaaacggcgggggggaccccaggggttcctgaacaaattcacaaaggggccaggaggacataaggggactctacaccaggagcgccaaaggaagcggatataagtcc

SEQ ID NO: 450746 - DNA, 1409 bp, Homo sapiens
  misc_feature (1230)..(1230): n is a, c, g, or t
caaatttccaagttgtcacacattactgatgatgatcagggcaggcatggaattctgctgacttgttccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtaaaaaaaaaaaaaaaaaaaccaaaaaaactttgggggccgcctgggcctcgaaaaggtttttaaaacccttcggtggggggcgggggcccacagaggtacactgtgaccctgggnccacaaggcgtgtcccacaagagaacaccggggacaagagcaaggccgcgggatttttctcaccagtaaaaaaaaacggcgggggggaccccaggggttcctgaacaaattcacaaaggggccaggaggacataaggggactctacaccaggagcgccaaaggaagcggatataagtcc

SEQ ID NO: 450747 - DNA, 1081 bp, Homo sapiens
  misc_feature (902)..(902): n is a, c, g, or t
gacccacgcgtccgtaggagatgattctgagaaaggaaaggccttgttggcagtactcctgttaagccattagtctctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtaaaaaaaaaaaaaaaaaaaccaaaaaaactttgggggccgcctgggcctcgaaaaggtttttaaaacccttcggtggggggcgggggcccacagaggtacactgtgaccctgggnccacaaggcgtgtcccacaagagaacaccggggacaagagcaaggccgcgggatttttctcaccagtaaaaaaaaacggcgggggggaccccaggggttcctgaacaaattcacaaaggggccaggaggacataaggggactctacaccaggagcgccaaaggaagcggatataagtcc

SEQ ID NO: 450748 - DNA, 2897 bp, Homo sapiens
gcagctgggagtagtactgccggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcatcggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagtaagttattaaaaggtatttgtaattatgtttcagctacagcctaacaaatgctgtagtaacatttcaatgtactctgttcagtgagctatacttctttttggtttatttttccttagttataaaaattatgatatgtacttatttttgaaaattgaaaatacataaaaacataaggaatagaagtgaaaccatctgtcttcataatatttagaaataaccactttaacattttgctgtgtatctttccagtcattttgtttttattttttttttttttgagacagagtctcacgctgttgcccaggctggagtgcagtggcgccatctcggctcactgcaacctctgcctcccagg

SEQ ID NO: 450749 - DNA, 511 bp, Homo sapiens
acagggggctttcctcagagaatatctttatgtttacaaggtgactgcttattttcattcaggaatagatattaaaactgtattttagtgtgaaagtatttatttattaccatatcttacgatagttttattagaatatatgtagttatcagtcataaaaaagctgtggcaggctaggctttttggctatagatcttggttacattgccccttccacagttcttgaaaagagaattttaatattacaatgaacacttgatttgtggctgttcttagaatcttaaaaaaaaaaaagattccacaggttttctggattctttattcatcatgcttttatagactcacaactgattttacagttggttttaagtgggttctctttaccatcctttggagatggacattctatgttcttttccttgtgaaagatgagggggtatggatctgtggaaagtagacaggctattatggtgcaatggagaaaaattaacaggaagaaggactgtttcac

SEQ ID NO: 450750 - DNA, 444 bp, Homo sapiens
aacacgggttttttttggccatgacagacgaccagcggatggttagtaaagttttatttagcctaattacctaatgacaatttaaaaaaaacttcttttcctttctccatttaaaaaacgatgtatagttgaatatttgaaaattaatagctcagccgggtacgattggctcatgcctgtaatcccagcactttgggaggctgaggccggcagatcatgaggtcaggagatcgagaccatcctggctaacatggtgaaaccccatctctactaaaaatacaaaaaattagctgggcgtggtggcacatgcttgtagtcccatcaactcaagaggctgaggtaggagaatggcgtgaacccgggaggcggaggttgcagtgagctgagatcacgacactgcactccagcctgggcgacagagtgaaactttgtctcaaaaaaaaa

SEQ ID NO: 450751 - DNA, 367 bp, Homo sapiens
ttacattgtagtaggtattataagtaatatagagattatttaaattatataagaggatgtgtatgggttaataggcaaatgctatacaattttatataaggaacttgacaaaccttggattttagtatcctggagggtcctggaaccatctccctgcaactatcctctaaaactgtaattggaatcttttgctgaacacatttactttgatgtgctaaggtattattgtgctattttatcttcttgtccttttttctataggaatatggtgttggctgaaagatgtgtgttgcttagtgctgaacttttaaaaagccaaagcaaatattcagaggctgcagctctcctaatacggttgaccagtgag

SEQ ID NO: 450752 - DNA, 5012 bp, Homo sapiens
gcagctgggagtagtactgccggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcatcggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgta

SEQ ID NO: 450753 - DNA, 5274 bp, Homo sapiens
gcagctgggagtagtactgccggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcatcggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggaggtgttctttatacattttcctacagggcttctctgtggagaaatccgaaaagcatatgtagaatttgtcaatgtcagcaaatgtccacttactggattgaaggttgtttctaaacgtccagagttctttactttcggtggtaatactgctgttctaacaccactaagtccctcagcttctgagaattgtagtgcttacaagactgttgtgacagatgctacctctgtgtgtacagcactcatatcatcagcttcttctgtagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgta

SEQ ID NO: 450754 - DNA, 5513 bp, Homo sapiens
  misc_feature (5334)..(5334): n is a, c, g, or t
gcagctgggagtagtactgccggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcatcggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggaggtgttctttatacattttcctacagggcttctctgtggagaaatccgaaaagcatatgtagaatttgtcaatgtcagcaaatgtccacttactggattgaaggttgtttctaaacgtccagagttctttactttcggtggtaatactgctgttctaacaccactaagtccctcagcttctgagaattgtagtgcttacaagactgttgtgacagatgctacctctgtgtgtacagcactcatatcatcagcttcttctgtagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagagagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtaaaaaaaaaaaaaaaaaaaccaaaaaaactttgggggccgcctgggcctcgaaaaggtttttaaaacccttcggtggggggcgggggcccacagaggtacactgtgaccctgggnccacaaggcgtgtcccacaagagaacaccggggacaagagcaaggccgcgggatttttctcaccagtaaaaaaaaacggcgggggggaccccaggggttcctgaacaaattcacaaaggggccaggaggacataaggggactctacaccaggagcgccaaaggaagcggatataagtcc

SEQ ID NO: 450755 - DNA, 2753 bp, Homo sapiens
gcagctgggagtagtactgccggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcatcggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggttagtaaagttttatttagcctaattacctaatgacaatttaaaaaaaacttcttttcctttctccatttaaaaaacgatgtatagttgaatatttgaaaattaatagctcagccggattacaggcatgagccaccgcgcccggccttccagttattttcatttgtatgtttttcccacatatttgggattccttcatactgtgtatgttgctttttacattctgtgttgttttataggcgtattctgatatcaaagtgtcttaatattttatttttgcataatattccatcatatgagtgattcataagctattttactatctttgatagttttttggcaagtttccatttgttgactatcacggtaatactgtggtgcacttttttgtgtgtggctttttacctttagattatttttgtggggaagattccagggcatgaagtgaagattttagggaaaagtattgtagtgccctgctggtttcataaaagttcataccaatgagcttcttactaagcagcatatgggtttgggtgt

SEQ ID NO: 450756 - DNA, 2621 bp, Homo sapiens
aggccacgagcacgggcgcgtgcttaagtcagcgcgcgcccgctccgacgcgaggaggccccgccctccagccccgccccgctcgctggcctgccctcctcttgctaccctcccggcgcagagaaccccggctgctcagcgcgctccgcggtcatggagatccccgggagcctgtgcaagaaagtcaagctgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaaaaaaaaa

SEQ ID NO: 450757 - DNA, 2383 bp, Homo sapiens
aggccacgagcacgggcgcgtgcttaagtcagcgcgcgcccgctccgacgcgaggaggccccgccctccagccccgccccgctcgctggcctgccctcctcttgctaccctcccggcgcagagaaccccggctgctcagcgcgctccgcggtcatggagatccccgggagcctgtgcaagaaagtcaagctgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttggggccacctattattatttatgtaacaacattaaaccgagggttagtttttttaatctctccctaagataatagataaccacaagaatctaaagtaactaattttaaaattgtctttttatattatatttatgcttctgtgtcatgattttttcaagctgttatattagttgtaaccagtagtattcacattaaatcttgctttttttcccctta

SEQ ID NO: 450758 - DNA, 2564 bp, Homo sapiens
ttccggggctgcggcgcctcccggctggggccgtgggtggttgcgaggcagaggggcgcggcgcagggtggggatctcgccctagcttggcgcagcgtgcggtccgagccaccgttcgtgggaagaacgccccccctccccagcgcctccgctcagggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaaaaaaaaa

SEQ ID NO: 450759 - DNA, 2270 bp, Homo sapiens
aggccacgagcacgggcgcgtgcttaagtcagcgcgcgcccgctccgacgcgaggaggccccgccctccagccccgccccgctcgctggcctgccctcctcttgctaccctcccggcgcagagaaccccggctgctcagcgcgctccgcggtcatggagatccccgggagcctgtgcaagaaagtcaagctgagcaataacgcgcagaactgggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaaaaaaaaa

SEQ ID NO: 450760 - DNA, 1600 bp, Homo sapiens
atttgggcatatttcttcttttttttttaaccccaacaatgactacatagggcatatttctttatgtgcacacacactctctctctctctctctctattttctatggaaggcttatatgtgacacatttatttctcacagttctagaggttgggaagtccaagatcaaggtgccagcagatgcggtgtctggtgaggaccctttttcctggttgtggatggctgccttcttgctgtgtccttatgtagaggaaagagcaagaatctcctgtctctttcttttcttataaggggattaatcccatcatagggggcccacccttttggcctcatttaattctaattacttccctaaggttttacctataagttcatagcaatgtttgtatatagttttgtgtcctggttattttatttatcattaatcacatcatgagcatcttatcccatccgtactttaatgactatgtaatattcgactcaggactatactgtaacttatttaggatctttcggcctttaggttatttatagtattttgctgttgtaaaatgactttcatatagctgtcttaggcataatatttgtctgcctctaattatttccttctaggtttgtagaagtgtgattattagttaaaacatacttggcatacctccagaagccagggccacttggtagtttatgattgcaccaggttttcaggttaagtctataaataatgaagagaggaaggaacatagaactgccaactagaagtaaacaggctcgtgatctggtgacctgagcgactctgaatgcttgctgagtcctagttggccatctaggttggttcccatgtttgagagacgaggatggatgaatttaagccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaaaaaaaaa

SEQ ID NO: 450761 - DNA, 1174 bp, Homo sapiens
aaagtagtatagtatgtaagtgcataagagaaattagtacaagtaaattaggaaagtctgagtaagattggtagattgtttccacactgataatcctggctgtgatatgctataattttgcaagatgttacctttgggaggaaactggataaagggtacaatggtgactggctatattatttcttacaatttcatgtgactctacaatggtctcaataaaaatttcaaaactaatttttttctggttctaaaaattggtaatattcaatagtggttttttgttcagtgacaaatttgaaatgagatttatattcacaagtactatgttcagtatttttttttcattaagtttgtctaatatgaacagaaggaacaaatgctttttaaaaatctaagtttctaaaattatgaaataattttctttttttcctctcctttagccccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaaaaaaaaa

SEQ ID NO: 450762 - DNA, 1260 bp, Homo sapiens
aggggaaaaaaagcaagatttaatgtgaatactactggttacaactaatataacagcttgaaaaaatcatgacacagaagcataaatataatataaaaagacaattttaaaattgtattgtaggaatataactataataagtggaaaagatacattaaaaccatcagtgtgttacacttgttcaaaacagaactcataaggcagaccaaaactgatgcaagttaaggaaactggataaagggtacaatggtgactggctatattatttcttacaatttcatgtgactctacaatggtctcaataaaaatttcaaaactaatttttttctggttctaaaaattggtaatattcaatagtggttttttgttcagtgacaaatttgaaatgagatttatattcacaagtactatgttcagtatttttttttcattaagtttgtctaatatgaacagaaggaacaaatgctttttaaaaatctaagtttctaaaattatgaaataattttctttttttcctctcctttagccccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaaaaaaaaa

SEQ ID NO: 450763 - DNA, 785 bp, Homo sapiens
tgatacaatcgagctcggtaccaggaaacagtatgactctgaagcacctaagaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaaaaaaaaa

SEQ ID NO: 450764 - DNA, 1204 bp, Homo sapiens
aggccacgagcacgggcgcgtgcttaagtcagcgcgcgcccgctccgacgcgaggaggccccgccctccagccccgccccgctcgctggcctgccctcctcttgctaccctcccggcgcagagaaccccggctgctcagcgcgctccgcggtcatggagatccccgggagcctgtgcaagaaagtcaagctgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgcctcaattggaaaggcctttggaaatgggggggaataaacctggtaaggcccttaatttttaaatgggaccccttgggtataaaggaaggtttgacggttttcccacatttgggctttaagttttaagggccccccttgtggggcctttttttcaaatcccaaaatttttttggaccccccg

SEQ ID NO: 450765 - DNA, 2378 bp, Homo sapiens
aggccacgagcacgggcgcgtgcttaagtcagcgcgcgcccgctccgacgcgaggaggccccgccctccagccccgccccgctcgctggcctgccctcctcttgctaccctcccggcgcagagaaccccggctgctcagcgcgctccgcggtcatggagatccccgggagcctgtgcaagaaagtcaagctgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttcccctta

SEQ ID NO: 450766 - DNA, 2498 bp, Homo sapiens
ggacgcgtgggtcgacccacgcgtcggacccacgcgtcggacccacgcgtcggcaagaaagtcaagctgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttatttcaggaacacgaatgcgcaaacttgctcgagaaggccagaaaccacctgaaggtttcatggctcccaaggcttggaccgtgctgacagaatactacaaatccttggagaaagcttaggctgttaacccagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacattaaatcttgctttttttccccttaaaaaaagaaaaaaattaccaaacaataaacttggctagaccttgttttgaggattttacaagacctttgtagcgattagattttttttctacattgaaaatagaaactgcttcctttcttctttccagtcagctattggtctttccagctgttataatctaaagtattcttatgatctgtgtaagctctgaatgaacttctttactcaataaaattaattttttggcttcttaaaaaaaaaaa

SEQ ID NO: 450767 - DNA, 2445 bp, Homo sapiens
aggccacgagcacgggcgcgtgcttaagtcagcgcgcgcccgctccgacgcgaggaggccccgccctccagccccgccccgctcgctggcctgccctcctcttgctaccctcccggcgcagagaaccccggctgctcagcgcgctccgcggtcatggagatccccgggagcctgtgcaagaaagtcaagctgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttggcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggtggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacagtaagtcttacattctctgtacaaatctttgaagtacttcgtggtctagctgctcccagggatttagcttattgtctaatctttactgatgacaggttttgtggtactcatgtcagagaaaggtaaacccagaaaagtaatttcccaacattctggaaattagaagtagaaataaaacttgaatctagtttcatggtttcaggaattttgttttgaagtctgtaaggacaatattgttatttctctgcctactgtgtctgctatagcttactgagcataactagtttgaggacttagtgatgtttactctggtaagcccagggagtctatgtatggagagagaatttagctaatatttgtgcaatcactatgtgacaggcaatgtcctaattatttacaagtattaaattatttataggttgtgtatcccttgtatgaaatgcttggggccagaagtgtttttgattttggattccttcagattttggaatatttgaatatttgaatgaggtaccttggggatgggactcaattctaaacatgaaattcatttatg

SEQ ID NO: 450768 - DNA, 3231 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450769 - DNA, 846 bp, Homo sapiens
atcaccttggctctagggagctagggtggggagcagtctggttttctcccatcttggagatctggtctgactctctagcctcagttcctctgactctgcttccatatctgataataaacagtggggtggggatggccctcagagggaactggctacttcctatgtgttgtggctcgctgtgacccaggaagccagggcctgggagcatcccaatcttgcaagtctgaatggcataatctcctgagacctatatgtccctggggtcatgtagtgaccggtgaggacctgctcactggggccaccaccttggcaccaggcactgcttgtgcccagccctcttctcgaatcctcctgaccctacctggacttgtccctgactccaatctgagctctgatactgagccagatacttcccctgacctggctcctctggtccccaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggtgaggggctgcaggagtctcccctgatgctcacctcccctgagctgcctcctaggtagcccatcaccccccttcccactctagggtccctgccctctccaaagcatattagaggcactttgctctcaggaagtagcctgaggccaggcccctgccttttcccggacccacctgataaatttccagctcctctcaacctcctcttgcatgctgcaattccacaggggggccatcg

SEQ ID NO: 450770 - DNA, 3189 bp, Homo sapiens
  misc_feature (159)..(159): n is a, c, g, or t
  misc_feature (181)..(181): n is a, c, g, or t
  misc_feature (265)..(265): n is a, c, g, or t
tgcatcaacgcgttgggagctctccatattgtctgactgcaggcggctggaattcactagtgattatcccgggtcctgggtaggggacacccgttccagtgagatgcccgagctcacctccatgcacaccctcttacttcgggagcacaaccggctggncacagagctcaagagcctgaancctaggtgggatggggagaggctctaccaggaagcccggaagatcgtgggggccatggtccagatcatcacttaccgggactancagccctctgaaggtgctgctctagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450771 - DNA, 3103 bp, Homo sapiens
ttgaatgcagtggattccatgcagcgtgattgaatgcagtggattccatgcagcctggtaaaatgcatcccgattgaatgcagtggattccatacagcgtgattgaatacagtggattccatgcagcctggtaaaatgcatcccgattgaatgcagtggattacgtgcagcatgagatgaccagtcctggtggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450772 - DNA, 4096 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagaaggtggccctgcttcccgcccactgcctgggttgggagaggggagattgtttctggaaggggccatctcccttctgtgcccaggtttcctttcccagacgctgaggaaggctggccctgcctcccttgtgtccacagcactggctgctcagctatgacctgtctccttcctgcgcctgggctcagccagctggcagccagggccgtccatttgctcactgcctctggcaggccaagggagagagggttgttcctccttggctgacaggagtcctgttggtggaatcactggctctttgttaggttgggagagggttctgggaggagaccttctcagtgccccccaagcctccatgctcagtcctgtttccgccccactgagagggcagccccaacccccatcacacagaaagagagagcctgggggtctggtgggtgccgtgggacagggctgggagtgggcagggtggtcgaggcactgctgagtagggaaggaggaggagagaaaggagagagcgcctgagagagggagagacagacaggagaatgtcagggccagagggagagcaggcacagcagagagaaggggagagagacgggcgacgctttagtgaggagggatccgaggcctggcggtgcccagacccaggggttgcccaggttcccagttcagtgttctgctcattaaccctgcacctcagaggctgttgctgatggcgccctaggcagcgatccctttcgggcctccggaggcctctctgcaggttgagggtaccagaggtcctgagggcagggggagatccagttctgcctgggcaccttccttgccctcggtgagccagtctagcctctctctgtgcctcagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450773 - DNA, 3313 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaaggtggggcacgaggcactgcccagctctgggcaaggatgtcccaggcctttcagagaagcagcaggcagcagggagcttgaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450774 - DNA, 3380 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactggtactgttgcccatcacaccccaggtccctgctccactagtgactcctcctagggaccccagtcgtctctcagtgatcccctcagcctcaggttgcctgggataggaagtgaggcggctcagctcccccattgttctttcccccggcagatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450775 - DNA, 3232 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatcgcaacggttttccaatcaagaacttgagtttcacgactgacacggccgagcgggcatccttcctcactggcgttaaaggagagaccagttgcgtgcagcaaccgccatgctgctcgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450776 - DNA, 2575 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggtgaggaggggcaggcgtcgtgggccgctgggtggctgtgggcccatccttgactctcttggagcccaaatttcctcctgtcagttgaaggactggagggagtcagtaattttccagtgtgttccaggaatcctccagatgccctggagtgcccacattgctttgcgcgccaagcaagtgggcacaattacatgaaataataataaccacaacaactaagttggttttttttttttttttctgtcttccagcttggagtgcagaggcatgatcttcgctcactgcaacatctgccttctggattctagcgattctcctgcctcagcctcccgagtagctgggattacaggtgcccacttgctgtgca

SEQ ID NO: 450777 - DNA, 2205 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggtgaggggctgcaggagtctcccctgatgctcacctcccctgagctgcctcctaggtagcccatcaccccccttcccactctagggtccctgccctctccaaagcatattagaggcactttgctctcaggaagtagcctgaggccaggcccctgccttttcccggacccacctgataaatttccagctcctctcaacctcctcttgcatgctgcaattccacaggggggccatcg

SEQ ID NO: 450778 - DNA, 1900 bp, Homo sapiens
  misc_feature (1)..(1): n is a, c, g, or t
  misc_feature (30)..(30): n is a, c, g, or t
  misc_feature (47)..(47): n is a, c, g, or t
ntcatgctcgtaccagactcggcacagtcngcgcgcatcccgcttcnggcagggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450779 - DNA, 2113 bp, Homo sapiens
gtcatgtgttggaagtgatacctattgaatgagcatccccaaccagcagcggccctgagctgaggcagaagctatcattgtggactggggcatcagggaaggcctcctagaggagtgtaaattggggatagtttgaaaagatggatggggaggaggggtgagtaggaggcatttcaggccttggctggggagggggtttcagtggagcaaatcttttctgggatggaggccttaagaatgacagtggcttttgcctccccaagggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450780 - DNA, 1831 bp, Homo sapiens
cctgtttgcggcctgctgagaatactgagtatgtggaaggcagcagagcggactggtgaggagcactcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450781 - DNA, 1789 bp, Homo sapiens
ctgtgtcctggttagcagagctggaccagtggtgccttggagggataagccagctgcagctgggctgtgtggatgacttatgggctcaggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450782 - DNA, 1872 bp, Homo sapiens
atcaccttggctctagggagctagggtggggagcagtctggttttctcccatcttggagatctggtctgactctctagcctcagttcctctgactctgcttccatatctgataataaacagtggggtggggatggccctcagagggaactggctacttcctatgtgttgtggctcgctgtgacccaggaagccagggcctgggagcatcccaatcttgcaagtctgaatggcataatctcctgagacctatatgtccctggggtcatgtagtgaccggtgaggacctgctcactggggccaccaccttggcaccaggcactgcttgtgcccagccctcttctcgaatcctcctgaccctacctggacttgtccctgactccaatctgagctctgatactgagccagatacttcccctgacctggctcctctggtccccaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450783 - DNA, 1573 bp, Homo sapiens
gtctcgcagtgctccggtacggtgacgcctcactcgtgcctggtgttccggctgcacaatcggtacgtgcccttggaaccccagccccgtgttctcctcagtagggtcttttgtgccttgctggaggattagtgttggaatgtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450784 - DNA, 1104 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatacccgccgtcataagcggtagcgagctcg

SEQ ID NO: 450785 - DNA, 845 bp, Homo sapiens
agatctgcgtggttgcagctgaccagcacagatatagagctcgctgctccccatccatgcctggcacttagctggcttcccgccagcaagtcaggttcaatgcagtaagtgtgcggcagttcacaaagtgccgaggatatgagttggacatgaagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450786 - DNA, 1081 bp, Homo sapiens
gtcatgtgttggaagtgatacctattgaatgagcatccccaaccagcagcggccctgagctgaggcagaagctatcattgtggactggggcatcagggaaggcctcctagaggagtgtaaattggggatagtttgaaaagatggatggggaggaggggtgagtaggaggcatttcaggccttggctggggagggggtttcagtggagcaaatcttttctgggatggaggccttaagaatgacagtggcttttgcctccccaagggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccaggtaggccgtcttgaacaccgggcacacgggatccagatgtgtccctgcaacatcctagctgtgtgaccttgggcaagttcctaacgctcctgagccttgccttcttcatccatgaggctgtaaggattataatacatatatgaaaacacctttcagatagtaagtgcttgacaaagcctccttcccttccctctccttcttcgcaggtttgctccctgcagtcttctttcctgtgggtctgttattggtgttgggagggttgaatgtttggtttagcgcccaagtagctgttcagtaaattcttcttccctccatctcactgtcactcttagctcctttacccactcacctcttctttttaaaattaaaaaaattatagggctgggcgcggtggctcatgcctgtaatcccagcactttgggaggcggaggcgggtggatcacgaggtcaggagatcaagaccatgctggctaacacggtgaaaccccatctctactaaaaatacaaaaattagccgggcgtggtggcgggcacctgtagtcccagctacttgggaggctgaggcaggagaatggcgtgaacccaggctggagtgcagtggtgcgatcttggctcactgcaacctccacctttcaggctcaagccattctcccatc

SEQ ID NO: 450787 - DNA, 1047 bp, Homo sapiens
tccttagcctcatttacccctggggcaatgttcctggttctgtctctcaacatctggtgcttcattgcccccaccctctccctcagaggcagaggcagacatacacacactcacacacacacacacacacacacacacactcctagattctggaggagagagttttcggtgctaagggtgagtttttgatttgcactaagaactcaagtgaaattcatttacactccaaaataacttctagactctagaatgtagagtgagactattccatgtcttcacttttcacagggaaaatcatgccagaatggcccttcgttccttcctgcctccctgctttccacaaacctaaactgagccttactgtgggcaggcacttggtgggcactgtgaagaatttcaacaacttcaatttcccttgctctcaaggactttataagatagttgcagaaatgagacattaataacttgaggacaaggaagttatcacaatgactaaaaaagtgatttgctatttagtcctctaaggcagagggcaatataattatccttaatgtacatttgaggaactcaggctcagagaggttaataattggtccaaggtcacccagccagcaagcagtagaactctatttatgcctctcagtgccactctgttaggcccaggtccggtattgtgggaggctattccctgaccatagagggatggaaggggtccccgaagccaagagcaggcagagactctggccctcctgtgctgccaggcggcatttgctgtggaggagtgggtggagaggccattccaaatgacttgtctttagatcatcacttaccgggaccccccgcactagtgcggtggggggttcccctgggtcatggactttccttggagtgtcctccagcgcaaaggacttcttcaaggatccccttgccatcccccatgggtgtgtgcctcatgctgtatcggttcccgaggaaactgccaaacagtcaaacctggggcctctggctgtgcttcacccatggagagggaataggtggcaggctaag

SEQ ID NO: 450788 - DNA, 426 bp, Homo sapiens
ccaacaacatcgacatctggatgggcggcgtgtccgagcctctgaagcgcaaaggccgcgtgggcccactcctcgcctgcatcatcggtacccagttcaggaagctccgggatggtgatcggtgaggaggggcaggcgtcgtgggccgctgggtggctgtgggcccatccttgactctcttggagcccaaatttcctcctgtcagttgaaggactggagggagtcagtaattttccagtgtgttccaggaatcctccagatgccctggagtgcccctaatgtgccctgaacctgttgggggtgcagcaaggaaagacctggacccctggttgtaaagggtggaagatagaaaagtgccacccttagctacttcttcccatgggtttcactgtgccaccatgtgggtgtcagtcaccagtgggcagt

SEQ ID NO: 450789 - DNA, 3289 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggtcagctttggggtggggaccagaggtggcataggagatgttccctgttggagccacagggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450790 - DNA, 2915 bp, Homo sapiens
tccctgctctgggcagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450791 - DNA, 3070 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450792 - DNA, 3204 bp, Homo sapiens
ctggatgggagaacagcttaaaagccatccttcccaaagccttgcctctgtctggacacccaggtccatatcctttttataaaaggaagccttcctcccacccgtgggcctgcctgcatggtcctgcatgtctgcccctgggctggggctctgctgggtgggtctgtatcccttctctggccctcactcctcctttctccaagcagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactggtactgttgcccatcacaccccaggtccctgctccactagtgactcctcctagggaccccagtcgtctctcagtgatcccctcagccttcttcctccagggagtctcaggagtctccagggctcctcagcctcaggttgcctgggataggaagtgaggcggctcagctcccccattgttctttcccccggcagatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450793 - DNA, 2868 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450794 - DNA, 1873 bp, Homo sapiens
gaatcaagtcagtccagactcggagggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450795 - DNA, 1672 bp, Homo sapiens
tcatatagactcgggttagtacccccgcggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450796 - DNA, 2506 bp, Homo sapiens
tccttagcctcatttacccctggggcaatgttcctggttctgtctctcaacatctggtgcttcattgcccccaccctctccctcagaggcagaggcagacatacacacactcacacacacacacacacacacacacacactcctagattctggaggagagagttttcggtgctaagggtgagtttttgatttgcactaagaactcaagtgaaattcatttacactccaaaataacttctagactctagaatgtagagtgagactattccatgtcttcacttttcacagggaaaatcatgccagaatggcccttcgttccttcctgcctccctgctttccacaaacctaaactgagccttactgtgggcaggcacttggtgggcactgtgaagaatttcaacaacttcaatttcccttgctctcaaggactttataagatagttgcagaaatgagacattaataacttgaggacaaggaagttatcacaatgactaaaaaagtgatttgctatttagtcctctaaggcagagggcaatataattatccttaatgtacatttgaggaactcaggctcagagaggttaataattggtccaaggtcacccagccagcaagcagtagaactctatttatgcctctcagtgccactctgttaggcccaggtccggtattgtgggaggctattccctgaccatagagggatggaaggggtccccgaagccaagagcaggcagagactctggccctcctgtgctgccaggcggcatttgctgtggaggagtgggtggagaggccattccaaatgacttgtctttagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450797 - DNA, 2199 bp, Homo sapiens
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccaggtaggccgtcttgaacaccgggcacacgggatccagatgtgtccctgcaacatcctagctgtgtgaccttgggcaagttcctaacgctcctgagccttgccttcttcatccatgaggctgtaaggattataatacatatatgaaaacacctttcagatagtaagtgcttgacaaagcctccttcccttccctctccttcttcgcaggtttgctccctgcagtcttctttcctgtgggtctgttattggtgttgggagggttgaatgtttggtttagcgcccaagtagctgttcagtaaattcttcttccctccatctcactgtcactcttagctcctttacccactcacctcttctttttaaaattaaaaaaattatagggctgggcgcggtggctcatgcctgtaatcccagcactttgggaggcggaggcgggtggatcacgaggtcaggagatcaagaccatgctggctaacacggtgaaaccccatctctactaaaaatacaaaaattagccgggcgtggtggcgggcacctgtagtcccagctacttgggaggctgaggcaggagaatggcgtgaacccaggctggagtgcagtggtgcgatcttggctcactgcaacctccacctttcaggctcaagccattctcccatc

SEQ ID NO: 450798 - DNA, 1385 bp, Homo sapiens
gtgttgggaaggtgggttttctgggctgctggcgatatgtgaatcttccctgctgtctccagtgacctccccaccttgaagcagagagacctgcccatagccacctgtcccctcccccatgcaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtct

SEQ ID NO: 450799 - DNA, 770 bp, Homo sapiens
  misc_feature (732)..(733): n is a, c, g, or t
tgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcannccacgctgggcctccttgtgcctctataagctccgct

SEQ ID NO: 450800 - DNA, 1068 bp, Homo sapiens
tccttagcctcatttacccctggggcaatgttcctggttctgtctctcaacatctggtgcttcattgcccccaccctctccctcagaggcagaggcagacatacacacactcacacacacacacacacacacacacacactcctagattctggaggagagagttttcggtgctaagggtgagtttttgatttgcactaagaactcaagtgaaattcatttacactccaaaataacttctagactctagaatgtagagtgagactattccatgtcttcacttttcacagggaaaatcatgccagaatggcccttcgttccttcctgcctccctgctttccacaaacctaaactgagccttactgtgggcaggcacttggtgggcactgtgaagaatttcaacaacttcaatttcccttgctctcaaggactttataagatagttgcagaaatgagacattaataacttgaggacaaggaagttatcacaatgactaaaaaagtgatttgctatttagtcctctaaggcagagggcaatataattatccttaatgtacatttgaggaactcaggctcagagaggttaataattggtccaaggtcacccagccagcaagcagtagaactctatttatgcctctcagtgccactctgttaggcccaggtccggtattgtgggaggctattccctgaccatagagggatggaaggggtccccgaagccaagagcaggcagagactctggccctcctgtgctgccaggcggcatttgctgtggaggagtgggtggagaggccattccaaatgacttgtctttagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaaccccccccgcactgtacccgcgtcgcactgggatcctcagagcgaccaacaaagc

SEQ ID NO: 450801 - DNA, 1083 bp, Homo sapiens
acgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggtgagtgcggacgctggccggatagcggagtgcccagggcgcgtgcggggtcttcgcgactgtccgccaggactcgcctgtgctccctgctcgcctcccagtccacgaatatctcagggatgagccatctggtcgtgactcttatgcatgaaaatctgagcaccctggcgagcagcggtcctgcttaagtcctctgtggtctgaacgaaagattttgaaaaaccttccacgttgaccttgctgtcatatcaagcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaa

SEQ ID NO: 450802 - DNA, 901 bp, Homo sapiens
ggcctcccgagtagctcggattacaggcgcccaacaccacgcccggctaatttttgtatttttagtagagacggggtttcaccatgttggccaggctggtcttgaactcctgacctcgcgatccacccgcctcggcctcccaaagtgctgggattacagacgtgagcaaccgcgcctagcctggagaagcagatatttatacatactcttgtatctttcaggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaa

SEQ ID NO: 450803 - DNA, 1029 bp, Homo sapiens
acgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagatcgctgctgtataatactgttatcaaaaaaaaaaaggggggggtctaaaattccgggggccagttagcgtccggtttctgtgcaggccaaggggtataaggaaggcggggggttacacggggggaaggctggttggaggacctctgggggatgggccccaggtagtgaaaaggtattggccttgggtttgttatacatgacaaggatgtggcggttatgatacccatcctacatc

SEQ ID NO: 450804 - DNA, 831 bp, Homo sapiens
acgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaa

SEQ ID NO: 450805 - DNA, 852 bp, Homo sapiens
  misc_feature (833)..(833): n is a, c, g, or t
  misc_feature (839)..(839): n is a, c, g, or t
acgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaatngacatngaagaaaaaacac

SEQ ID NO: 450806 - DNA, 778 bp, Homo sapiens
acgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaa

SEQ ID NO: 450807 - DNA, 943 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaa

SEQ ID NO: 450808 - DNA, 1074 bp, Homo sapiens
tcagtgaactacttggcttgaatagcacagattgtattagccaaaaaggagtcagggtggcaccataattattaaaggaggcaacaccttaacattagtctttttaaatatgtgtcatcttgaatttcatgtctttgattgaattgggctataagcataggcttctctggaggtaagtagattgaaaagcactcctcaacagaaaagcttaaaagtaaatatcatcataagcattcatttaaaaaagaaagcctgtttttgatccagaagttgtgacttttcattctctgtgatgttggtgataactcttaattcaattgtgaccttgtttttcttcctttcaatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaa

SEQ ID NO: 450809 - DNA, 431 bp, Homo sapiens
gggaggatagacagcttcagcttcttatcaggaccaaaaacaaacaccacacgagctgtcactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaa

SEQ ID NO: 450810 - DNA, 652 bp, Homo sapiens
aggaatacaaggaaagctagcatgcttggagaagaagctgcagaaggtggggtgagggacaagagatgagaggaggcaggattccatcacacagggcttgcaggccatgatactcagaattaaatgtaaagtgtggtggccagctgttactgggtttaaaacaggactgtttcttgttaagatgggggaactgctttcctgccaaaagtgccaaagatcaacttggaaaacaaaatcctcacagaggggagagtaaagaacacttgattagtctcattagcacctgtagctacttttctaaagttaattcctgaaggccttgaagcttcactatgagattgaatttcaccattctcaatgtctttcaataggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaa

SEQ ID NO: 450811 - DNA, 556 bp, Homo sapiens
gagccggtccggaagatctggtggtgatggctgttaactgatgaaattcagagcatgtgttgggtttagattcctctttccccttttacttgtgtttcaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtaggtcatacaaattcattttgtagttagcttaactgatcaggctgtatgtccgtgtaaatgctggtaccagctagaggagataggggaatatctacgattatgaaataactgtgtattggcgacaatatcactgattatctgtaatgctgatgcaattttcagctaaattttccaactgctttattcatagttcatggaaatctacaaaaaaaaagttgtttatcctaaaatgtcttccagaattgagaaaccttttcatagctctcctgactgctctcctgaccgccctgtctttaaagtgatggg

SEQ ID NO: 450812 - DNA, 2652 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgggaaaaaaaaaaaaaaaaaaaaaaaaaaaaaaaaaaaaaaaaaaaaaaagaaaaaaaaaaaaagaaaaatgccaaacaagagaagaagaagaaaaaaatagaaaagacacaaagaagacaggacaaaagacagacacacaaacatagcccgacaacaatgaccaaacaaacaacaaaacgtaagaaaagcatgaagtaatatcaaccgagataaacagcaagcagctcggcacctggctgggcagggaccaacgttcccctagcaagtggcgaggagacggttaacatacgagaatacgtcaatcggtttgagcgtaccactcaacgcacggaaaagcagcttaacgagctgtgacaattaacataaacgtaaaaacagaaaatctccagattatagacgacatacaggaaaggagacatggaaccataacagagcaagactataaaaacagaatgcaacaaggaacaaaatcacatgcaaaaaacacatctaaaacaacattaaacgaaaatcaagaacaaaggagtggcacaggtaccgaaaaagtgagaagacacagaaataaggagaagacagacaagagcagaacagaaaggaaaagggtacaaggaaaataaagtcaccgaggatgacgaacacaaaaacaaaaagtatagcacgcattgaaagcgaaaaagcaaaaaggacaacacaacaaaatcaagaaaaagaccaaaaaaaaaaaaagagaacaagacaaagaaagacacaaagacaaacaacaaaacaaaaaacgaagaagaaagacacaatagaaaaaacagaacaacagagccaaaaacagacaactatacaagaagaaaagaaaaacagaatacaaaaaagaaagtaaaaataacgaaaaacaacacaaaagcaacgcaaaaaaaaacacactca

SEQ ID NO: 450813 - DNA, 1490 bp, Homo sapiens
  misc_feature (1427)..(1427): n is a, c, g, or t
  misc_feature (1434)..(1434): n is a, c, g, or t
  misc_feature (1445)..(1445): n is a, c, g, or t
  misc_feature (1448)..(1450): n is a, c, g, or t
  misc_feature (1459)..(1459): n is a, c, g, or t
  misc_feature (1468)..(1468): n is a, c, g, or t
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagcttnattggtnaacaagggggnttnnnagggggggnaaagcctgnccaggggagtggaaaaaagggg

SEQ ID NO: 450814 - DNA, 2173 bp, Homo sapiens
  misc_feature (10)..(10): n is a, c, g, or t
  misc_feature (458)..(458): n is a, c, g, or t
  misc_feature (506)..(506): n is a, c, g, or t
acgcaggctngctcaccgctcccgcactacccgggatacaccagatgctctatacatattcttttaatacatcttgatccacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgnaaaaaaaaaaaaaaaaaaaaaaaaaaaaaaaaaaaaaaaaaaaaaaancccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450815 - DNA, 1691 bp, Homo sapiens
gacccacgcgtcgcggacgcgtgggccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450816 - DNA, 1408 bp, Homo sapiens
  misc_feature (1294)..(1294): n is a, c, g, or t
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgatntgttggttccaagcttctgaataaccagaggctacattttaatatcggctcaggggacaactacatgaccgtaaggaaggagaaccaattgtaaatggatcaaggggaaacttc

SEQ ID NO: 450817 - DNA, 1697 bp, Homo sapiens
ttcgtctaggtacgaggcctgggtgtgagcaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450818 - DNA, 953 bp, Homo sapiens
  misc_feature (884)..(884): n is a, c, g, or t
  misc_feature (908)..(908): n is a, c, g, or t
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatctgggtctcccngcaggtttaggtgcttaccatgcntttaatgaaatgggtcaaaaaaaaaaaagggggggtagagaccgg

SEQ ID NO: 450819 - DNA, 1866 bp, Homo sapiens
tcagtgaactacttggcttgaatagcacagattgtattagccaaaaaggagtcagggtggcaccataattattaaaggaggcaacaccttaacattagtctttttaaatatgtgtcatcttgaatttcatgtctttgattgaattgggctataagcataggcttctctggaggtaagtagattgaaaagcactcctcaacagaaaagcttaaaagtaaatatcatcataagcattcatttaaaaaagaaagcctgtttttgatccagaagttgtgacttttcattctctgtgatgttggtgataactcttaattcaattgtgaccttgtttttcttcctttcaatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450820 - DNA, 1568 bp, Homo sapiens
ttcggccgatccggttccatctattttctgggtatatcatgggtgtctatttcttcttcttcctctctcttctttactttacgcgttgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450821 - DNA, 1662 bp, Homo sapiens
ctgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggaaaaggatggtcatggatccagagatctccacccacgcgtccgcccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450822 - DNA, 1751 bp, Homo sapiens
tcagtgaactacttggcttgaatagcacagattgtattagccaaaaaggagtcagggtggcaccataattattaaaggaggcaacaccttaacattagtctttttaaatatgtgtcatcttgaatttcatgtctttgattgaattgggctataagcataggcttctctggaggtaagtagattgaaaagcactcctcaacagaaaagcttaaaagtaaatatcatcataagcattcatttaaaaaagaaagcctgtttttgatccagaagttgtgacttttcattctctgtgatgttggtgataactcttaattcaattgtgaccttgtttttcttcctttcactttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450823 - DNA, 1681 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagtgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450824 - DNA, 921 bp, Homo sapiens
  misc_feature (920)..(920): n is a, c, g, or t
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctagctagttttggagtgtgtttggcaagtgtgtgatggttttgggattcttaattcggttagcagtttggttcaggttttgtgggaaaaaaaagggggggataaatggggggaagaagtacgatggcagggggagttttcgctgggng

SEQ ID NO: 450825 - DNA, 1110 bp, Homo sapiens
tcgatcgagctcggtaccggcccccggggaatggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450826 - DNA, 1444 bp, Homo sapiens
aggaatacaaggaaagctagcatgcttggagaagaagctgcagaaggtggggtgagggacaagagatgagaggaggcaggattccatcacacagggcttgcaggccatgatactcagaattaaatgtaaagtgtggtggccagctgttactgggtttaaaacaggactgtttcttgttaagatgggggaactgctttcctgccaaaagtgccaaagatcaacttggaaaacaaaatcctcacagaggggagagtaaagaacacttgattagtctcattagcacctgtagctacttttctaaagttaattcctgaaggccttgaagcttcactatgagattgaatttcaccattctcaatgtctttcaataggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450827 - DNA, 1763 bp, Homo sapiens
  misc_feature (10)..(10): n is a, c, g, or t
  misc_feature (458)..(458): n is a, c, g, or t
  misc_feature (506)..(506): n is a, c, g, or t
acgcaggctngctcaccgctcccgcactacccgggatacaccagatgctctatacatattcttttaatacatcttgatccacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgnaaaaaaaaaaaaaaaaaaaaaaaaaaaaaaaaaaaaaaaaaaaaaaancccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450828 - DNA, 1582 bp, Homo sapiens
  misc_feature (10)..(10): n is a, c, g, or t
  misc_feature (458)..(458): n is a, c, g, or t
  misc_feature (506)..(506): n is a, c, g, or t
acgcaggctngctcaccgctcccgcactacccgggatacaccagatgctctatacatattcttttaatacatcttgatccacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgnaaaaaaaaaaaaaaaaaaaaaaaaaaaaaaaaaaaaaaaaaaaaaaancccaaccggttgcttgctgtcccagcggcgccccctcatcacgaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450829 - DNA, 1659 bp, Homo sapiens
  misc_feature (10)..(10): n is a, c, g, or t
  misc_feature (458)..(458): n is a, c, g, or t
  misc_feature (506)..(506): n is a, c, g, or t
acgcaggctngctcaccgctcccgcactacccgggatacaccagatgctctatacatattcttttaatacatcttgatccacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgnaaaaaaaaaaaaaaaaaaaaaaaaaaaaaaaaaaaaaaaaaaaaaaancccaaccggttgcttgctgtcccagcggcgccccctcatcaccgtcgccatgcccggaggtctgcttctcggggacgtggctcccaactttgaggccaataccaccgtcggccgcatccgaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450830 - DNA, 1074 bp, Homo sapiens
  misc_feature (26)..(26): n is a, c, g, or t
atgatgcatgctcggagcgggccgcnagtgtggtggaattgaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450831 - DNA, 872 bp, Homo sapiens
gcagggcttgagttttaaatacagaacatatttcaaacagaaccagcagagtgctgatgtatgaatggaattgattgctgaaggcagagagtataaaagaatctcaagaaacttttagtgccattttcatttaatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450832 - DNA, 1446 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaagatggagtctccttctgtcacccaagctggagtgcagtggcgtgatcttggcccactgcaacctctgcctcccgggttcaagtgattctcctgcctcagcctcctgagtagctggaactacaggcacacaccaccacgcctggctagtttttgtattattagtagagatggggtttcaccatattgaccaggctggtctcaaactcctgacctcatgatccacccaccttggcctcccaaaatgttggtattacagttgtgagccgccacgcctggccctaaatgttttcttaaattaaacacttataaatcttccagatatcaccttttgtcaaaattcaataattatgaatggaccttactatactgatgctttcttactaagctcctctctaccctgaatgcaagagaccctcatagttaggcaagaatatcatcaccccattcaacctgaaaaagctacagaagatggatcgtcatccctctgcaaccctcaggattaaggattctttcataaaagggagagggaaatgtcagagacatgtgaaccagagcatctccatcttaaataagagctgggtaaaatgaggctgaaagttactgggctgcattcccagacggataaagcaatctaagtcatgaagtcagcacaaaatacaggtcataatgaccttgctgataaaacaggttgcagtaaaggagccagccaaaaccaaaatggtgacaagactgacctctggtcgtcctcactgctacactcccatcagcaccatgacagtttacaa

SEQ ID NO: 450833 - DNA, 719 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaagttttgcaagaggaatgtcaactctgaatgccctatcaatagacatgtgtgagaccat

SEQ ID NO: 450834 - DNA, 1735 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450835 - DNA, 1682 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttcttcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450836 - DNA, 2494 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgggaaaaaaaaaaaaaaaaaaaaaaaaaaaaaaaaaaaaaaaaaaaaaaagaaaaaaaaaaaaagaaaaatgccaaacaagagaagaagaagaaaaaaatagaaaagacacaaagaagacaggacaaaagacagacacacaaacatagcccgacaacaatgaccaaacaaacaacaaaacgtaagaaaagcatgaagtaatatcaaccgagataaacagcaagcagctcggcacctggctgggcagggaccaacgttcccctagcaagtggcgaggagacggttaacatacgagaatacgtcaatcggtttgagcgtaccactcaacgcacggaaaagcagcttaacgagctgtgacaattaacataaacgtaaaaacagaaaatctccagattatagacgacatacaggaaaggagacatggaaccataacagagcaagactataaaaacagaatgcaacaaggaacaaaatcacatgcaaaaaacacatctaaaacaacattaaacgaaaatcaagaacaaaggagtggcacaggtaccgaaaaagtgagaagacacagaaataaggagaagacagacaagagcagaacagaaaggaaaagggtacaaggaaaataaagtcaccgaggatgacgaacacaaaaacaaaaagtatagcacgcattgaaagcgaaaaagcaaaaaggacaacacaacaaaatcaagaaaaagaccaaaaaaaaaaaaagagaacaagacaaagaaagacacaaagacaaacaacaaaacaaaaaacgaagaagaaagacacaatagaaaaaacagaacaacagagccaaaaacagacaactatacaagaagaaaagaaaaacagaatacaaaaaagaaagtaaaaataacgaaaaacaacacaaaagcaacgcaaaaaaaaacacactca

SEQ ID NO: 450837 - DNA, 1705 bp, Homo sapiens
aagagtggtatcaacgcagagtgccccattacggccgggccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450838 - DNA, 1313 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaactaaagaaaaaaccagagcggccaagttttgattttgataatttaagaaataaaaaaaaataaa

SEQ ID NO: 450839 - DNA, 1795 bp, Homo sapiens
cccccccgtccgaccgtcggaccgtaccctccgtaccgccgagtgacgaccctaagggtctccccacgacgccggccacgatcatggcgagaccgcggcaactcgtatgcaacataaacgagtacagcgacggaccgacaaatgcccgggaattcggccatacgccggggcgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450840 - DNA, 1662 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaaacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450841 - DNA, 1670 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450842 - DNA, 1270 bp, Homo sapiens
tccaaaagcttccagggataggaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 450843 - DNA, 904 bp, Homo sapiens
ccagtccccgcccctcgcgcgcttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgttttggtcctgataagaagctgaagctgtctatcctctacccagctaccactggcaggaactttgatgagattctcagggtagtcatctctctccagctgacagcagaaaaaagggttgccaccccagttgattggaaggaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaa

SEQ ID NO: 450844 - DNA, 650 bp, Homo sapiens
  misc_feature (6)..(6): n is a, c, g, or t
  misc_feature (10)..(10): n is a, c, g, or t
tatggncggntcaccgggagaaactatatgggggtgaagctggagatatttcggatgataatctacctgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaa

SEQ ID NO: 450845 - DNA, 4567 bp, Homo sapiens
ggtggtcttgaactcctgacctcaggtaatccgcctgcctcggcctcccaaagtgctgggattacaggcgtgagccgcgcccggccagctgctgctgttttagacaatggttgatgaaggattcgaaggcctaaacaatagagcttttgttctgttttgtttttgagtggtcctgaacagttcttttgggcaggggaatttgtctgtgtgtgaatgtgcaaacatatatataatctgagtggctgcctggccttgtcctaggttttgtcccgtatatacgccgtctttttttttttttctttctgcatgtatgtatattttctcaaggcatctgtcctgcactagactttggcttgtctttccaggccagcttccagaggatgctttggcagttttccctctgggtaaccaagcaggctgcagccagcagatggcactgcagcagaaaggggcagagtccctttaggcccttgacaagcacggcggattagtaaccgtataatttaaccctccagttagccttggaggactcggtgtcgcacttccgcccgaactctaataaagcgggccgagttgtgtgcaattaaggatttcagtatgcaaatctgaatctgtacttttgtctcctccaccccacccccatcattagactggcaatgtcttttgtcacgttgtcaaagtgtcctcagagaagcggtgtctagatatcgccgatttctggttaaagtggctgaagtgatcccagcattaattaaatgcaggagaatcgagattctcctgatagtttaaggaaaagaaaaattcacacaagcaaacgggcaaccctttgaatgttttccgacgacgtggtgctttaggatctgaaagatgcgacttggtttttgttgttgttgttgttgttgttgttgtttttgagacggagtttccgctcttgttgcccaggctggagtgcaatggcgcgatctcggctcaccgcaacctccgcctcccaggttcaagcgattctcctgcctcggcctcccgagtagctgggattacattacaggcatgagccaccatgcccggctaattttgtatttgtagtagagacggggtttctccatgttggtcaggctggtctcgaactacgatctcaggtgatccgcctgcctcggcctcctaaagtgcttagattacaggcatgagccaccgcgcccggctaattttgtatgtttagtagagacggggtttctccttgttggtcaggctggtctcgaactccgacctcaggtgatccgcctggctcggcctcccaaagtgctgggattacaggcgtgaaccaccgcgcccggccgcgacttgtttttgttacaaggttcctcatttcatttgcaacgttcagacgcagtctgactagatttccatccggagtaaggaagagcagctcaagggcagtcacggaggccgcaggtgcggcttcttcacccgcggtgctggagttctctcaagtggaagcccaggacgatgaaaacctcataggtaggctgctgcttacacacagcagccgccacggcgcaaaataaactacaaaactacaagcctttaccttttcaaacacactgacgcgggccagccccagccctacgcccgcaggggcacgcagaaaagacttagttaccacggccaagtaggaagccttcgagatagcgttcttcttaccctacgtaaacacgcagtttcccgagctcgacaatcggctagccactcctgatagcgttcggcgctcgcctctcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgctgtgattggaaccaggctgcatgctgctgtggcaattgcttgtgttgtaatggccttttacgtcctgtttataaaatgaattccaaagcacccaagtcatcaactgccaaccaaggggacggggatgaagaacctgttggagacctgaacccagtgtaggagagttcagctgaaatcatcggtccccaggatgacaccacagcatctgcccctgctatatgtggggaaaactcatggtcacgaacattatttatgcttcaggggactacagaaagccagcttcctttgatctatgtgtaaatcagtccttggcagagtgcatataatgtccggataaattacacccctcggtgataagattacatacctccttcataaaaacctgtcatcctgttttgttcttcagctcctcatcaggatcttttcaaactgaggctcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacaagaaaaaatctttctgttcaccagtatcctcaaatggagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacctttgagatgagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaa

SEQ ID NO: 450846 - DNA, 4525 bp, Homo sapiens
ggtggtcttgaactcctgacctcaggtaatccgcctgcctcggcctcccaaagtgctgggattacaggcgtgagccgcgcccggccagctgctgctgttttagacaatggttgatgaaggattcgaaggcctaaacaatagagcttttgttctgttttgtttttgagtggtcctgaacagttcttttgggcaggggaatttgtctgtgtgtgaatgtgcaaacatatatataatctgagtggctgcctggccttgtcctaggttttgtcccgtatatacgccgtctttttttttttttctttctgcatgtatgtatattttctcaaggcatctgtcctgcactagactttggcttgtctttccaggccagcttccagaggatgctttggcagttttccctctgggtaaccaagcaggctgcagccagcagatggcactgcagcagaaaggggcagagtccctttaggcccttgacaagcacggcggattagtaaccgtataatttaaccctccagttagccttggaggactcggtgtcgcacttccgcccgaactctaataaagcgggccgagttgtgtgcaattaaggatttcagtatgcaaatctgaatctgtacttttgtctcctccaccccacccccatcattagactggcaatgtcttttgtcacgttgtcaaagtgtcctcagagaagcggtgtctagatatcgccgatttctggttaaagtggctgaagtgatcccagcattaattaaatgcaggagaatcgagattctcctgatagtttaaggaaaagaaaaattcacacaagcaaacgggcaaccctttgaatgttttccgacgacgtggtgctttaggatctgaaagatgcgacttggtttttgttgttgttgttgttgttgttgttgtttttgagacggagtttccgctcttgttgcccaggctggagtgcaatggcgcgatctcggctcaccgcaacctccgcctcccaggttcaagcgattctcctgcctcggcctcccgagtagctgggattacattacaggcatgagccaccatgcccggctaattttgtatttgtagtagagacggggtttctccatgttggtcaggctggtctcgaactacgatctcaggtgatccgcctgcctcggcctcctaaagtgcttagattacaggcatgagccaccgcgcccggctaattttgtatgtttagtagagacggggtttctccttgttggtcaggctggtctcgaactccgacctcaggtgatccgcctggctcggcctcccaaagtgctgggattacaggcgtgaaccaccgcgcccggccgcgacttgtttttgttacaaggttcctcatttcatttgcaacgttcagacgcagtctgactagatttccatccggagtaaggaagagcagctcaagggcagtcacggaggccgcaggtgcggcttcttcacccgcggtgctggagttctctcaagtggaagcccaggacgatgaaaacctcataggtaggctgctgcttacacacagcagccgccacggcgcaaaataaactacaaaactacaagcctttaccttttcaaacacactgacgcgggccagccccagccctacgcccgcaggggcacgcagaaaagacttagttaccacggccaagtaggaagccttcgagatagcgttcttcttaccctacgtaaacacgcagtttcccgagctcgacaatcggctagccactcctgatagcgttcggcgctcgcctctcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgctgtgattggaaccaggctgcatgctgctgtggcaattgcttgtgttgtaatggccttttacgtcctgtttataaaatgaattccaaagcacccaagtcatcaactgccaaccaaggggacggggatgaagaacctgttggagacctgaacccagtgtaggagagttcagctgaaatcatcggtccccaggatgacaccacagcatctgcccctgctatatgtggggaaaactcatggtcacgaacattatttatgcttcaggggactacagaaagccagcttcctttgatctatgtgtaaatcagtccttggcagagtgcatataatgtccggataaattacacccctcggtgataagattacatacctccttcataaaaacctgtcatcctgttttgttcttcagctcctcatcaggatcttttcaaactgaggctcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacctttgagatgagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaa

SEQ ID NO: 450847 - DNA, 4435 bp, Homo sapiens
ggtggtcttgaactcctgacctcaggtaatccgcctgcctcggcctcccaaagtgctgggattacaggcgtgagccgcgcccggccagctgctgctgttttagacaatggttgatgaaggattcgaaggcctaaacaatagagcttttgttctgttttgtttttgagtggtcctgaacagttcttttgggcaggggaatttgtctgtgtgtgaatgtgcaaacatatatataatctgagtggctgcctggccttgtcctaggttttgtcccgtatatacgccgtctttttttttttttctttctgcatgtatgtatattttctcaaggcatctgtcctgcactagactttggcttgtctttccaggccagcttccagaggatgctttggcagttttccctctgggtaaccaagcaggctgcagccagcagatggcactgcagcagaaaggggcagagtccctttaggcccttgacaagcacggcggattagtaaccgtataatttaaccctccagttagccttggaggactcggtgtcgcacttccgcccgaactctaataaagcgggccgagttgtgtgcaattaaggatttcagtatgcaaatctgaatctgtacttttgtctcctccaccccacccccatcattagactggcaatgtcttttgtcacgttgtcaaagtgtcctcagagaagcggtgtctagatatcgccgatttctggttaaagtggctgaagtgatcccagcattaattaaatgcaggagaatcgagattctcctgatagtttaaggaaaagaaaaattcacacaagcaaacgggcaaccctttgaatgttttccgacgacgtggtgctttaggatctgaaagatgcgacttggtttttgttgttgttgttgttgttgttgttgtttttgagacggagtttccgctcttgttgcccaggctggagtgcaatggcgcgatctcggctcaccgcaacctccgcctcccaggttcaagcgattctcctgcctcggcctcccgagtagctgggattacattacaggcatgagccaccatgcccggctaattttgtatttgtagtagagacggggtttctccatgttggtcaggctggtctcgaactacgatctcaggtgatccgcctgcctcggcctcctaaagtgcttagattacaggcatgagccaccgcgcccggctaattttgtatgtttagtagagacggggtttctccttgttggtcaggctggtctcgaactccgacctcaggtgatccgcctggctcggcctcccaaagtgctgggattacaggcgtgaaccaccgcgcccggccgcgacttgtttttgttacaaggttcctcatttcatttgcaacgttcagacgcagtctgactagatttccatccggagtaaggaagagcagctcaagggcagtcacggaggccgcaggtgcggcttcttcacccgcggtgctggagttctctcaagtggaagcccaggacgatgaaaacctcataggtaggctgctgcttacacacagcagccgccacggcgcaaaataaactacaaaactacaagcctttaccttttcaaacacactgacgcgggccagccccagccctacgcccgcaggggcacgcagaaaagacttagttaccacggccaagtaggaagccttcgagatagcgttcttcttaccctacgtaaacacgcagtttcccgagctcgacaatcggctagccactcctgatagcgttcggcgctcgcctctcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgccgctgtgattggaaccaggctgcatgctgctgtggcaattgcttgtgttgtaatggccttttacgtcctgtttataaaatgaattccaaagcacccaagtcatcaactgccaaccaaggggacggggatgaagaacctgttggagacctgaacccagtgtaggagagttcagctgaaatcatcggtccccaggatgacaccacagcatctgcccctgctatatgtggggaaaactcatggtcacgaacattatttatgcttcaggggactacagaaagccagcttcctttgatctatgtgtaaatcagtccttggcagagtgcatataatgtccggataaattacacccctcggtgataagattacatacctccttcataaaaacctgtcatcctgttttgttcttcagctcctcatcaggatcttttcaaactgaggctcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacaagaaaaaatctttctgttcaccagtatcctcaaatggagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacctttgagatgagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaa

SEQ ID NO: 450848 - DNA, 4513 bp, Homo sapiens
ggtggtcttgaactcctgacctcaggtaatccgcctgcctcggcctcccaaagtgctgggattacaggcgtgagccgcgcccggccagctgctgctgttttagacaatggttgatgaaggattcgaaggcctaaacaatagagcttttgttctgttttgtttttgagtggtcctgaacagttcttttgggcaggggaatttgtctgtgtgtgaatgtgcaaacatatatataatctgagtggctgcctggccttgtcctaggttttgtcccgtatatacgccgtctttttttttttttctttctgcatgtatgtatattttctcaaggcatctgtcctgcactagactttggcttgtctttccaggccagcttccagaggatgctttggcagttttccctctgggtaaccaagcaggctgcagccagcagatggcactgcagcagaaaggggcagagtccctttaggcccttgacaagcacggcggattagtaaccgtataatttaaccctccagttagccttggaggactcggtgtcgcacttccgcccgaactctaataaagcgggccgagttgtgtgcaattaaggatttcagtatgcaaatctgaatctgtacttttgtctcctccaccccacccccatcattagactggcaatgtcttttgtcacgttgtcaaagtgtcctcagagaagcggtgtctagatatcgccgatttctggttaaagtggctgaagtgatcccagcattaattaaatgcaggagaatcgagattctcctgatagtttaaggaaaagaaaaattcacacaagcaaacgggcaaccctttgaatgttttccgacgacgtggtgctttaggatctgaaagatgcgacttggtttttgttgttgttgttgttgttgttgttgtttttgagacggagtttccgctcttgttgcccaggctggagtgcaatggcgcgatctcggctcaccgcaacctccgcctcccaggttcaagcgattctcctgcctcggcctcccgagtagctgggattacattacaggcatgagccaccatgcccggctaattttgtatttgtagtagagacggggtttctccatgttggtcaggctggtctcgaactacgatctcaggtgatccgcctgcctcggcctcctaaagtgcttagattacaggcatgagccaccgcgcccggctaattttgtatgtttagtagagacggggtttctccttgttggtcaggctggtctcgaactccgacctcaggtgatccgcctggctcggcctcccaaagtgctgggattacaggcgtgaaccaccgcgcccggccgcgacttgtttttgttacaaggttcctcatttcatttgcaacgttcagacgcagtctgactagatttccatccggagtaaggaagagcagctcaagggcagtcacggaggccgcaggtgcggcttcttcacccgcggtgctggagttctctcaagtggaagcccaggacgatgaaaacctcataggtaggctgctgcttacacacagcagccgccacggcgcaaaataaactacaaaactacaagcctttaccttttcaaacacactgacgcgggccagccccagccctacgcccgcaggggcacgcagaaaagacttagttaccacggccaagtaggaagccttcgagatagcgttcttcttaccctacgtaaacacgcagtttcccgagctcgacaatcggctagccactcctgatagcgttcggcgctcgcctctcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgctgtgattggaaccaggctgcatgctgctgtggcaattgcttgtgttgtaatggccttttacgtcctgtttatgaagaacctgttggagacctgaacccagtgtaggagagttcagctgaaatcatcggtccccaggatgacaccacagcatctgcccctgctatatgtggggaaaactcatggtcacgaacattatttatgcttcaggggactacagaaagccagcttcctttgatctatgtgtaaatcagtccttggcagagtgcatataatgtccggataaattacacccctcggtgataagattacatacctccttcataaaaacctgtcatcctgttttgttcttcagctcctcatcaggatcttttcaaactgaggctcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacaagaaaaaatctttctgttcaccagtatcctcaaatggagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacctttgagatgagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaa

SEQ ID NO: 450849 - DNA, 4514 bp, Homo sapiens
ggtggtcttgaactcctgacctcaggtaatccgcctgcctcggcctcccaaagtgctgggattacaggcgtgagccgcgcccggccagctgctgctgttttagacaatggttgatgaaggattcgaaggcctaaacaatagagcttttgttctgttttgtttttgagtggtcctgaacagttcttttgggcaggggaatttgtctgtgtgtgaatgtgcaaacatatatataatctgagtggctgcctggccttgtcctaggttttgtcccgtatatacgccgtctttttttttttttctttctgcatgtatgtatattttctcaaggcatctgtcctgcactagactttggcttgtctttccaggccagcttccagaggatgctttggcagttttccctctgggtaaccaagcaggctgcagccagcagatggcactgcagcagaaaggggcagagtccctttaggcccttgacaagcacggcggattagtaaccgtataatttaaccctccagttagccttggaggactcggtgtcgcacttccgcccgaactctaataaagcgggccgagttgtgtgcaattaaggatttcagtatgcaaatctgaatctgtacttttgtctcctccaccccacccccatcattagactggcaatgtcttttgtcacgttgtcaaagtgtcctcagagaagcggtgtctagatatcgccgatttctggttaaagtggctgaagtgatcccagcattaattaaatgcaggagaatcgagattctcctgatagtttaaggaaaagaaaaattcacacaagcaaacgggcaaccctttgaatgttttccgacgacgtggtgctttaggatctgaaagatgcgacttggtttttgttgttgttgttgttgttgttgttgtttttgagacggagtttccgctcttgttgcccaggctggagtgcaatggcgcgatctcggctcaccgcaacctccgcctcccaggttcaagcgattctcctgcctcggcctcccgagtagctgggattacattacaggcatgagccaccatgcccggctaattttgtatttgtagtagagacggggtttctccatgttggtcaggctggtctcgaactacgatctcaggtgatccgcctgcctcggcctcctaaagtgcttagattacaggcatgagccaccgcgcccggctaattttgtatgtttagtagagacggggtttctccttgttggtcaggctggtctcgaactccgacctcaggtgatccgcctggctcggcctcccaaagtgctgggattacaggcgtgaaccaccgcgcccggccgcgacttgtttttgttacaaggttcctcatttcatttgcaacgttcagacgcagtctgactagatttccatccggagtaaggaagagcagctcaagggcagtcacggaggccgcaggtgcggcttcttcacccgcggtgctggagttctctcaagtggaagcccaggacgatgaaaacctcataggtaggctgctgcttacacacagcagccgccacggcgcaaaataaactacaaaactacaagcctttaccttttcaaacacactgacgcgggccagccccagccctacgcccgcaggggcacgcagaaaagacttagttaccacggccaagtaggaagccttcgagatagcgttcttcttaccctacgtaaacacgcagtttcccgagctcgacaatcggctagccactcctgatagcgttcggcgctcgcctctcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgctgtgattggaaccaggctgcatgctgctgtggcaattgcttgtgttgtaatggccttttacgtcctgtttataaaatgaattccaaagcacccaagtcatcaactgccaaccaaggggacggggatgaagaacctgttggagacctgaacccagtgtaggagagttcagctgaaatcatcggtccccaggatgacaccacagcatctgcccctgctatatgtggggcttcctttgatctatgtgtaaatcagtccttggcagagtgcatataatgtccggataaattacacccctcggtgataagattacatacctccttcataaaaacctgtcatcctgttttgttcttcagctcctcatcaggatcttttcaaactgaggctcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacaagaaaaaatctttctgttcaccagtatcctcaaatggagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacctttgagatgagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaa

SEQ ID NO: 450850 - DNA, 4966 bp, Homo sapiens
ggtggtcttgaactcctgacctcaggtaatccgcctgcctcggcctcccaaagtgctgggattacaggcgtgagccgcgcccggccagctgctgctgttttagacaatggttgatgaaggattcgaaggcctaaacaatagagcttttgttctgttttgtttttgagtggtcctgaacagttcttttgggcaggggaatttgtctgtgtgtgaatgtgcaaacatatatataatctgagtggctgcctggccttgtcctaggttttgtcccgtatatacgccgtctttttttttttttctttctgcatgtatgtatattttctcaaggcatctgtcctgcactagactttggcttgtctttccaggccagcttccagaggatgctttggcagttttccctctgggtaaccaagcaggctgcagccagcagatggcactgcagcagaaaggggcagagtccctttaggcccttgacaagcacggcggattagtaaccgtataatttaaccctccagttagccttggaggactcggtgtcgcacttccgcccgaactctaataaagcgggccgagttgtgtgcaattaaggatttcagtatgcaaatctgaatctgtacttttgtctcctccaccccacccccatcattagactggcaatgtcttttgtcacgttgtcaaagtgtcctcagagaagcggtgtctagatatcgccgatttctggttaaagtggctgaagtgatcccagcattaattaaatgcaggagaatcgagattctcctgatagtttaaggaaaagaaaaattcacacaagcaaacgggcaaccctttgaatgttttccgacgacgtggtgctttaggatctgaaagatgcgacttggtttttgttgttgttgttgttgttgttgttgtttttgagacggagtttccgctcttgttgcccaggctggagtgcaatggcgcgatctcggctcaccgcaacctccgcctcccaggttcaagcgattctcctgcctcggcctcccgagtagctgggattacattacaggcatgagccaccatgcccggctaattttgtatttgtagtagagacggggtttctccatgttggtcaggctggtctcgaactacgatctcaggtgatccgcctgcctcggcctcctaaagtgcttagattacaggcatgagccaccgcgcccggctaattttgtatgtttagtagagacggggtttctccttgttggtcaggctggtctcgaactccgacctcaggtgatccgcctggctcggcctcccaaagtgctgggattacaggcgtgaaccaccgcgcccggccgcgacttgtttttgttacaaggttcctcatttcatttgcaacgttcagacgcagtctgactagatttccatccggagtaaggaagagcagctcaagggcagtcacggaggccgcaggtgcggcttcttcacccgcggtgctggagttctctcaagtggaagcccaggacgatgaaaacctcataggtaggctgctgcttacacacagcagccgccacggcgcaaaataaactacaaaactacaagcctttaccttttcaaacacactgacgcgggccagccccagccctacgcccgcaggggcacgcagaaaagacttagttaccacggccaagtaggaagccttcgagatagcgttcttcttaccctacgtaaacacgcagtttcccgagctcgacaatcggctagccactcctgatagcgttcggcgctcgcctctcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgctgtgattggaaccaggctgcatgctgctgtggcaattgcttgtgttgtaatggccttttacgtcctgtttataaaatgaattccaaagcacccaagtcatcaactgccaaccaaggggacggggatgaagaacctgttggagacctgaacccagtgtaggagagttcagctgaaatcatcggtccccaggatgacaccacagcatctgcccctgctatatgtggggaaaactcatggtcacgaacattatttatgcttcaggggactacagaaagccagcttcctttgatctatgtgtaaatcagtccttggcagagtgcatataatgtccggataaattacacccctcggtgataagattacatacctccttcataaaaacctgtcatcctgttttgttcttcagctcctcatcaggatcttttcaaactgaggctcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacaagaaaaaatctttctgttcaccagtatcctcaaatggagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacctttgagatgagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaaccttaaaatgaaaaacaacacgacaaccacaaaaaataacaacaaacacacaacaaaaatcacacagcagcaagaacaacaaagagggggggcgcgccgcacgaaaaagcacgccccaggggtgggagcaccacgagaagaagcgagaagacacacgggactactcagatgcacaaaaagggcgcgcccccaaataggaagcgagcatcttatataaaaacccacacccgaacaacgcgccaccacacattacaaaaaaaaacaatcaaagcaaaagacgtgaaacaaacatcggcacacaatggagcaacaccggtgcgacagagaagaccccacaagcaaacggagaagagtgaacaaaacagacgcgagaaaacgacaacacgagctacaggcaca

SEQ ID NO: 450851 - DNA, 2504 bp, Homo sapiens
ggtggtcttgaactcctgacctcaggtaatccgcctgcctcggcctcccaaagtgctgggattacaggcgtgagccgcgcccggccagctgctgctgttttagacaatggttgatgaaggattcgaaggcctaaacaatagagcttttgttctgttttgtttttgagtggtcctgaacagttcttttgggcaggggaatttgtctgtgtgtgaatgtgcaaacatatatataatctgagtggctgcctggccttgtcctaggttttgtcccgtatatacgccgtctttttttttttttctttctgcatgtatgtatattttctcaaggcatctgtcctgcactagactttggcttgtctttccaggccagcttccagaggatgctttggcagttttccctctgggtaaccaagcaggctgcagccagcagatggcactgcagcagaaaggggcagagtccctttaggcccttgacaagcacggcggattagtaaccgtataatttaaccctccagttagccttggaggactcggtgtcgcacttccgcccgaactctaataaagcgggccgagttgtgtgcaattaaggatttcagtatgcaaatctgaatctgtacttttgtctcctccaccccacccccatcattagactggcaatgtcttttgtcacgttgtcaaagtgtcctcagagaagcggtgtctagatatcgccgatttctggttaaagtggctgaagtgatcccagcattaattaaatgcaggagaatcgagattctcctgatagtttaaggaaaagaaaaattcacacaagcaaacgggcaaccctttgaatgttttccgacgacgtggtgctttaggatctgaaagatgcgacttggtttttgttgttgttgttgttgttgttgttgtttttgagacggagtttccgctcttgttgcccaggctggagtgcaatggcgcgatctcggctcaccgcaacctccgcctcccaggttcaagcgattctcctgcctcggcctcccgagtagctgggattacattacaggcatgagccaccatgcccggctaattttgtatttgtagtagagacggggtttctccatgttggtcaggctggtctcgaactacgatctcaggtgatccgcctgcctcggcctcctaaagtgcttagattacaggcatgagccaccgcgcccggctaattttgtatgtttagtagagacggggtttctccttgttggtcaggctggtctcgaactccgacctcaggtgatccgcctggctcggcctcccaaagtgctgggattacaggcgtgaaccaccgcgcccggccgcgacttgtttttgttacaaggttcctcatttcatttgcaacgttcagacgcagtctgactagatttccatccggagtaaggaagagcagctcaagggcagtcacggaggccgcaggtgcggcttcttcacccgcggtgctggagttctctcaagtggaagcccaggacgatgaaaacctcataggtaggctgctgcttacacacagcagccgccacggcgcaaaataaactacaaaactacaagcctttaccttttcaaacacactgacgcgggccagccccagccctacgcccgcaggggcacgcagaaaagacttagttaccacggccaagtaggaagccttcgagatagcgttcttcttaccctacgtaaacacgcagtttcccgagctcgacaatcggctagccactcctgatagcgttcggcgctcgcctctcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaaggtgaggccatgtctggacagggagaagagactgccatctctggacagtgtggagctacaaagtagggagtacagtgagctgggattatatttggtttcatttttagaaaaaaatccctccgattgggtctgagagtctggaaaattaatcattctccaaagttgagggaagaggtaaaagttaaaatttgctgggtgtgatggctcatgcctataatctcagcactttggggggccaaggcaggaggattgcttgtgtccaggagttgtagatcagcccgggcaacacagtgagaccccatttctacaaaatatacaaaaattagccaggtatggtggcacgtgcctgtagtcccagttactcaggagactgaggtgggaggattgcttgagcctaggaggttgaggctgcagtgagccatggtggagccactgcactccagcccaggtgacag

SEQ ID NO: 450852 - DNA, 4588 bp, Homo sapiens
ggtggtcttgaactcctgacctcaggtaatccgcctgcctcggcctcccaaagtgctgggattacaggcgtgagccgcgcccggccagctgctgctgttttagacaatggttgatgaaggattcgaaggcctaaacaatagagcttttgttctgttttgtttttgagtggtcctgaacagttcttttgggcaggggaatttgtctgtgtgtgaatgtgcaaacatatatataatctgagtggctgcctggccttgtcctaggttttgtcccgtatatacgccgtctttttttttttttctttctgcatgtatgtatattttctcaaggcatctgtcctgcactagactttggcttgtctttccaggccagcttccagaggatgctttggcagttttccctctgggtaaccaagcaggctgcagccagcagatggcactgcagcagaaaggggcagagtccctttaggcccttgacaagcacggcggattagtaaccgtataatttaaccctccagttagccttggaggactcggtgtcgcacttccgcccgaactctaataaagcgggccgagttgtgtgcaattaaggatttcagtatgcaaatctgaatctgtacttttgtctcctccaccccacccccatcattagactggcaatgtcttttgtcacgttgtcaaagtgtcctcagagaagcggtgtctagatatcgccgatttctggttaaagtggctgaagtgatcccagcattaattaaatgcaggagaatcgagattctcctgatagtttaaggaaaagaaaaattcacacaagcaaacgggcaaccctttgaatgttttccgacgacgtggtgctttaggatctgaaagatgcgacttggtttttgttgttgttgttgttgttgttgttgtttttgagacggagtttccgctcttgttgcccaggctggagtgcaatggcgcgatctcggctcaccgcaacctccgcctcccaggttcaagcgattctcctgcctcggcctcccgagtagctgggattacattacaggcatgagccaccatgcccggctaattttgtatttgtagtagagacggggtttctccatgttggtcaggctggtctcgaactacgatctcaggtgatccgcctgcctcggcctcctaaagtgcttagattacaggcatgagccaccgcgcccggctaattttgtatgtttagtagagacggggtttctccttgttggtcaggctggtctcgaactccgacctcaggtgatccgcctggctcggcctcccaaagtgctgggattacaggcgtgaaccaccgcgcccggccgcgacttgtttttgttacaaggttcctcatttcatttgcaacgttcagacgcagtctgactagatttccatccggagtaaggaagagcagctcaagggcagtcacggaggccgcaggtgcggcttcttcacccgcggtgctggagttctctcaagtggaagcccaggacgatgaaaacctcataggtaggctgctgcttacacacagcagccgccacggcgcaaaataaactacaaaactacaagcctttaccttttcaaacacactgacgcgggccagccccagccctacgcccgcaggggcacgcagaaaagacttagttaccacggccaagtaggaagccttcgagatagcgttcttcttaccctacgtaaacacgcagtttcccgagctcgacaatcggctagccactcctgatagcgttcggcgctcgcctctcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgctgtgattggaaccaggctgcatgctgctgtggcaattgcttgtgttgtaatggccttttacgtcctgtttataaaatgaattccaaagcacccaagtcatcaactgccaaccaaggggacggggatgaagaacctgttggagacctgaacccagtgtaggagagttcagctgaaatcatcggtccccaggatgacaccacagcatctgcccctgctatatgtggggaaaactcatggtcacgaacattatttatgcttcaggggactacagaaagccagcttcctttgatctatgtgtaaatcagtccttggcagagtgcatataatgtccggataaattacacccctcggtgataagattacatacctccttcataaaaacctgtcatcctgttttgttcttcagctcctcatcaggatcttttcaaactgaggctcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacaagaaaaaatctttctgttcaccagtatcctcaaatggagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacctttgagatgagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaaaaaataatgataaagaaaaaa

SEQ ID NO: 450853 - DNA, 1885 bp, Homo sapiens
tgtcattgggtatgcttccatctgcattgagcattctggtaatttgttgatatcccctcttctgttttctcacaaccagtcttttgttggtgtagatttattctattctatagttgttttcttttcatagtggagtgtttttagagagacacgaagtatctgctcagtctgccttgttgaatcagaaacacctcacctattctttttttactgtgtgctattagggaattgtattagcaagctaatttaggatttcttttataataacgttatattaaaagtaaaagctttaatgacagagaacaatgttaaattctagtaattcgataagtaatttataaagcatttttattctgtttttcagaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgttttttttttttttcccccttcttttttgggtcttgatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatctgtttgttaggatttgaaattctggaaaatatttatctacatcgcctcagactaaaagtaaaaaaaataagctttctataattagggagatttctgcacagagaagtaacattgtggttaattttaaatgaaaaacttaactttttcaagtggggataaataatacaactaaatttctgtaatagtaagattctatatgccttcagataaacttgcctattgagatggtaatttaaagccaaagcatagcagtttcttttgtgtgtagtgaggttgaagcagatttgcagggtgaagtattgaaagtttatgtgactttaagtcagcttttgaaaagtgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaactcgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaa

SEQ ID NO: 450854 - DNA, 434 bp, Homo sapiens
aagaaaacgaaatgtgatagaattactgagaaaataattcactatttctttacatggatgactggtttggatctagagtatgtatttttttttttcattacattacaggaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatg

SEQ ID NO: 450855 - DNA, 482 bp, Homo sapiens
tgtcattgggtatgcttccatctgcattgagcattctggtaatttgttgatatcccctcttctgttttctcacaaccagtcttttgttggtgtagatttattctattctatagttgttttcttttcatagtggagtgtttttagagagacacgaagtatctgctcagtctgccttgttgaatcagaaacacctcacctattctttttttactgtgtgctattagggaattgtattagcaagctaatttaggatttcttttataataacgttatattaaaagtaaaagctttaatgacagagaacaatgttaaattctagtaattcgataagtaatttataaagcatttttattctgtttttcagaaacggtgggagcccagagtatatgagatgtcttcagaggctcatctaactctgtccttacatactcaatgcatatatgaaaacaatactaaataaacatctgatctgtataaaaatg

SEQ ID NO: 450856 - DNA, 6575 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatg

SEQ ID NO: 450857 - DNA, 7978 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgttttttttttttttcccccttcttttttgggtcttgatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatctgtttgttaggatttgaaattctggaaaatatttatctacatcgcctcagactaaaagtaaaaaaaataagctttctataattagggagatttctgcacagagaagtaacattgtggttaattttaaatgaaaaacttaactttttcaagtggggataaataatacaactaaatttctgtaatagtaagattctatatgccttcagataaacttgcctattgagatggtaatttaaagccaaagcatagcagtttcttttgtgtgtagtgaggttgaagcagatttgcagggtgaagtattgaaagtttatgtgactttaagtcagcttttgaaaagtgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaactcgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaa

SEQ ID NO: 450858 - DNA, 6692 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgctagagaaaatgaggaggaggatgttcggactatagattcagctgtgggatctggttctgtagctgagagcacatcgctaaacatagatgtgcagtctgaggcttcagataccacggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatg

SEQ ID NO: 450859 - DNA, 6507 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatg

SEQ ID NO: 450860 - DNA, 2820 bp, Homo sapiens
acatgtttaattaaaactgtcttttaatttcattttaaagctaaagacatttatttatttttctcttacccattgcttttactgattaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatg

SEQ ID NO: 450861 - DNA, 7975 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctgaattttctaaaatttttttttcttccctttttaccttcatatattcctgggttgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgttttttttttttttcccccttcttttttgggtcttgatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatctgtttgttaggatttgaaattctggaaaatatttatctacatcgcctcagactaaaagtaaaaaaaataagctttctataattagggagatttctgcacagagaagtaacattgtggttaattttaaatgaaaaacttaactttttcaagtggggataaataatacaactaaatttctgtaatagtaagattctatatgccttcagataaacttgcctattgagatggtaatttaaagccaaagcatagcagtttcttttgtgtgtagtgaggttgaagcagatttgcagggtgaagtattgaaagtttatgtgactttaagtcagcttttgaaaagtgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaactcgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaa

SEQ ID NO: 450862 - DNA, 6526 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagttgaagatttaccactgaaactgacaatatattcagaggcagatctaagaaagaaaatggtagaagaagaacagaaaaaccatgtgaaatgcagaccgaagaattagctggaaattctgagacactaaaagaacctgaaacggtgggagcccagagtatatgagataactctgtccttacatactcaatgcatatatgaaaacaatactaaataaacatctgatctgtataaaaatg

SEQ ID NO: 450863 - DNA, 6346 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatatttgtcttttacagtttggtgtcagagtaggatttgaaagagaccccctgtggcctctggaagcatcgaggaaccaggcaaaaggtgtccattgtg

SEQ ID NO: 450864 - DNA, 2185 bp, Homo sapiens
agaagatacttttaaatttctttgtatgaaggtcttgggttggacaaaaactacacactagtaatcatctcttttatagtgaccatatatttcaggccctgctattaaaacatttttcccttctaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgttttttttttttttcccccttcttttttgggtcttgatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatctgtttgttaggatttgaaattctggaaaatatttatctacatcgcctcagactaaaagtaaaaaaaataagctttctataattagggagatttctgcacagagaagtaacattgtggttaattttaaatgaaaaacttaactttttcaagtggggataaataatacaactaaatttctgtaatagtaagattctatatgccttcagataaacttgcctattgagatggtaatttaaagccaaagcatagcagtttcttttgtgtgtagtgaggttgaagcagatttgcagggtgaagtattgaaagtttatgtgactttaagtcagcttttgaaaagtgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaactcgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaa

SEQ ID NO: 450865 - DNA, 5236 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgtaagctgataatgattagtgaattgtagatataattttagtatgcagtaaataaaagttaaatagattattgtcaaattgtaggtagacctaatatatttgattttcagctttttttaaaacttgggtataatgtgttattttattttgagggcgagatataatatgcaatcaaaatatggtagcaaacaccaaaaattatgtatgtatgatagattatgaggtctgagatagccatatttatgttgttattacccagtataggggctgactcttaaaagacatttacaaatgtatgttgtatttatttaagacattcagtaaaacaggtatcagattacagtaaaaacacttgaatgaataaatacaggataaatcaggtctttgggttaaa

SEQ ID NO: 450866 - DNA, 2272 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgctagagaaaatgaggaggaggatgttcggactatagattcagctgtgggatctggttctgtagctgagagcacatcgctaaacatagatgtgcagtctgaggcttcagataccacggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataaaaa

SEQ ID NO: 450867 - DNA, 509 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagagagagttaattgttaaatccagtatggccacaggaggaggtccctttgaagatggcatgaatgatcaggatttaccaaactggagtaatgagaatgtaagcccgtgggcgattatgagaatgaatgcgtccggtgaagcttacagggggtatacatgcgaagggctcg

SEQ ID NO: 450868 - DNA, 521 bp, Homo sapiens
ttctttttaacattaacaaaatatacaaacttccttttctgtaatgaagtccatattagcaaaagcaaaaaagaaattagcacttagcttatttctaagtgttgaaagattttcactgatttttcctataaaatgtataatattttctgtatattttatatgatcagaaataaacatggttcttagtaatgctaggtaatgttattcattaaagtttcatttttagtataaaatgcatatcttgatattttaagattttatttatcttggtaatattaagcttcttttctactttaaaagctctgaaatagaattgtctaaaatagaatttttagataatttaaagctgagagtaatgatactagctaataaaagttgtcatgaaggtacttcatcaatattaactttctggtcttttatgtattccagaaactgggagtgatttttccatgtttgaagctttgcgagatactatttattctgaagtagctacattaatttctcaaaatgaatctcgtcca

SEQ ID NO: 450869 - DNA, 727 bp, Homo sapiens
agttttcagtatatcgatggactttagttaatgtataatagcatccagttactatatacttgttttcaatctttcgctatttagaaacaatgcaccaaagaatatacttgcacaagcttttgtgcatttgtgttttttaagaaggatttggagaagtggaactactatgtcagttggtgtacattttaaaggacacaacttaattggtctctagaacaattagttttctagagagcaattttctatatgtatttccgtatgtatttatatttctatatgtatagaatttttgatatgtattcatatttttctatatgtattttttatattttaagcagtggtatgtgagagttcgtttctccacacccttgattgtgttttattttattgatataccgtagcttgtttaaccattactggaattggccttttccaaatttcccaattataagaagagttattgaggtgagataaacatgtatgcaaatacaaacgtgtgtaaacaaatatatattgaacacgtgtacacatgtatacaaacgtgctttctttactgctttaatctttttatgtaaattttacagactagtggtatttactaaggtatgaattggataatgtcttgaggtatcaagattgttttaatgtaatgatgctctttcaggatgatgatgcagctcaaggagttatctctgccagtgcatcaaatttggatgatttctaccca

SEQ ID NO: 450870 - DNA, 405 bp, Homo sapiens
acagagaaacgattggatcagcacagtgtaaagagttgtttgcttctgctttaagtaatgacctcttgcaaaactgtcaggtgtctgaagaagatgggaggggagaacctgcaatggagagcagccaggtgataacgtttgtttcttttgctcattctttacacaaacctcaaaataccaacagtaaggtttagaaaattaggttacgcacacaggaattttagttgggtggaattaaagtgcttcactgacctcctttgttaatctgccagatttacttaaaatagagtaaatttctgtttatccaaaaatattttagaaatggcatattcaggttagttaaaggcttctgtttatttacaaaatagcatattgccagtttttagtaaagggggattggaagga

SEQ ID NO: 450871 - DNA, 345 bp, Homo sapiens
tgggtcaaaatagccaagcctctcaatacgtatgaataaagtaggagtgtggcttttcttatgaatggatatttctaaacagacatctgaaaattgaggagcatctacggcaagaaaattaaaaattaacatttggtattatatggattgattttctttttttaaacaataggtaagtttatattctaaccaactaggatttttctcaggagcacatggatgaagtatgctcctcgcagcttctaacttcagtaaggcgcatggttttgacccttacccagcaaaatgatgagagcaaagagtttgtaaagttctttcataaacaacttggaagtatattacagg

SEQ ID NO: 450872 - DNA, 316 bp, Homo sapiens
taaacaataggtaagtttatattctaaccaactaggatttttctcaggagcacatggatgaagtatgctcctcgcagcttctaacttcagtaaggcgcatggttttgacccttacccagcaaaatgatgagagcaaagagtttgtaaagttctttcataaacaacttggaagtatattacaggtaagagtttatacttgtatgatttaccaatatgtactgtgtggtaaggttttttttcggggggtgggtgaggcattttcttgcattacacaatttattctggtggacatccaatctagcgtccatttgggatg

SEQ ID NO: 450873 - DNA, 607 bp, Homo sapiens
acgttttttgtgaattcctttttagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgaggtattgtaaattgtactctcttgttcctgagttagtcttttgttttcctttttttttcttcaataaggcacatctcaggaaaggaaactgaatatccttgaaacatgtttgtaaatagtagtctgctttgtgccttttttagtagacacaaaaatgtaatagattataataatataagaaagataaaacattttaatttttaaactttaattgaaaagttttaaataattttttctaaaaagtaattatcttttaaaaatatccatgttctttgttagtaaatatttgacagaaatatataggggggtagttgcagcaaatagtaatcatttcagttagaaagacctatcctttgacattttatttatatgtggtttgtagaaaatataatttttcctaaataatttctgaagtatatttgagttctacttgtttctatta

SEQ ID NO: 450874 - DNA, 6599 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatg

SEQ ID NO: 450875 - DNA, 731 bp, Homo sapiens
attcgcggccgcgtcgaccagagttgaaaacatcaaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgtaagctgataatgattagtgaattgtagatataattttagtatgcagtaaataaaagttaaatagattattgtcaaattgtaggtagacctaatatatttgattttcagctttttttaaaacttgggtataatgtgttattttattttgagggcgagatataatatgcaatcaaaatatggtagcaaacaccaaaaattatgtatgtatgatagattatgaggtctgagatagccatatttatgttgttattacccagtataggggctgactcttaaaagacatttacaaatgtatgttgtatttatttaagacattcagtaaaacaggtatcagattacagtaaaaacacttgaatgaataaatacaggataaatcaggtctttgggttaaa

SEQ ID NO: 450876 - DNA, 6410 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatg

SEQ ID NO: 450877 - DNA, 3981 bp, Homo sapiens
tgctcttgatgatcccccagactttaccatgtcttcaaaacgatgtggaaacttgaagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatg

SEQ ID NO: 450878 - DNA, 7648 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgttttttttttttttcccccttcttttttgggtcttgatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatctgtttgttaggatttgaaattctggaaaatatttatctacatcgcctcagactaaaagtaaaaaaaataagctttctataattagggagatttctgcacagagaagtaacattgtggttaattttaaatgaaaaacttaactttttcaagtggggataaataatacaactaaatttctgtaatagtaagattctatatgccttcagataaacttgcctattgagatggtaatttaaagccaaagcatagcagtttcttttgtgtgtagtgaggttgaagcagatttgcagggtgaagtattgaaagtttatgtgactttaagtcagcttttgaaaagtgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaactcgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaa

SEQ ID NO: 450879 - DNA, 6288 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgtatgtatcatttacatttccaaatatttttacttttca

SEQ ID NO: 450880 - DNA, 6301 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcatctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactataagcagaatctggtaatataagtcaaaagttccgttgagccgtcggggtccg

SEQ ID NO: 450881 - DNA, 5293 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagcacatgctaggagaatactacagcagtctaacagaaatgcatgcaatgaagcgccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgtaagctgataatgattagtgaattgtagatataattttagtatgcagtaaataaaagttaaatagattattgtcaaattgtaggtagacctaatatatttgattttcagctttttttaaaacttgggtataatgtgttattttattttgagggcgagatataatatgcaatcaaaatatggtagcaaacaccaaaaattatgtatgtatgatagattatgaggtctgagatagccatatttatgttgttattacccagtataggggctgactcttaaaagacatttacaaatgtatgttgtatttatttaagacattcagtaaaacaggtatcagattacagtaaaaacacttgaatgaataaatacaggataaatcaggtctttgggttaaa

SEQ ID NO: 450882 - DNA, 1365 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgcccctcttctcccaccacaatgagatgctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaaagccaacggaggaggccttagttaataaggcgcgactgctgagtattaactcc

SEQ ID NO: 450883 - DNA, 524 bp, Homo sapiens
atcccccgcgctgcaggacattcggcaccaggccaagctgataaaacacaagaagggcattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450884 - DNA, 2317 bp, Homo sapiens
gggctccagggaactacagctcccagcatgccccggggcccgcaaccgtccgccgcccggtgcactgtggacgatgagtcagggttaggggcgccaggacgtgggcgtgcaggacgcgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450885 - DNA, 753 bp, Homo sapiens
actagttctagctcgcgatctagaactaggtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450886 - DNA, 3652 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450887 - DNA, 3807 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggtaagacagagaattgggtgggggtagaggtggggaggacagtgagtcctgactgctggaccctcttcccccatagggacaaaggaaaggagctctctgggcttggcagtgctctaaagaatccctttgggaatgctggcctcctgctaggagaggcaggcaaacagctgaggcgggtaggcttagggccagagccaggggagggcagggtggtgtatggcaactaaccagtcattctccctcttcctctcaggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450888 - DNA, 3725 bp, Homo sapiens
  misc_feature (3679)..(3679): n is a, c, g, or t
  misc_feature (3682)..(3682): n is a, c, g, or t
  misc_feature (3691)..(3691): n is a, c, g, or t
  misc_feature (3695)..(3695): n is a, c, g, or t
  misc_feature (3699)..(3699): n is a, c, g, or t
  misc_feature (3709)..(3709): n is a, c, g, or t
  misc_feature (3712)..(3712): n is a, c, g, or t
  misc_feature (3714)..(3714): n is a, c, g, or t
  misc_feature (3716)..(3716): n is a, c, g, or t
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcaaaaaaaaaacaaacacaaaaaccacanaanacaacaaanaaanaaancaaaaacaanaanananaaaaacaca

SEQ ID NO: 450889 - DNA, 3638 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatgcagtcattctccctcttcctctcaggcgggcagggctgggcagcggcctgagtctcagcggacttgtccacccggagttgagtcggagtggcgagctggtaagcggccaggggtccaggagagcctgcatcagggactgcaccgatggcccctctgagccccgcactgtccccatctcttaaggcagtacgggctctggagcagtttgccactgtggtggaggccaagctatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450890 - DNA, 3596 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450891 - DNA, 3636 bp, Homo sapiens
  misc_feature (3635)..(3636): n is a, c, g, or t
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttcctttcttaggctggttgtccgagggctatgtccgcatggctgttagatatggtgaatattttccgcacgccttgggttgtttatttnn

SEQ ID NO: 450892 - DNA, 3746 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgaggtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450893 - DNA, 3809 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatgcagtcattctccctcttcctctcaggcgggcagggctgggcagcggcctgagtctcagcggacttgtccacccggagttgagtcggagtggcgagctggtaagcggccaggggtccaggagagcctgcatcagggactgcaccgatggcccctctgagccccgcactgtccccatctcttaaggcagtacgggctctggagcagtttgccactgtggtggaggccaagctatgaacagtttctgctgcagcggctggcagacggggccatcgacctctatgccatggtggtggttctctcgaggtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgaggtgagactcggggctgccaagctcaggtgagggctggaggtgcaggcccaacccctccttccctctccccaggctgcgctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450894 - DNA, 3622 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450895 - DNA, 3593 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaattggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450896 - DNA, 3819 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggtaagacagagaattgggtgggggtagaggtggggaggacagtgagtcctgactgctggaccctcttcccccatagggacaaaggaaaggagctctctgggcttggcagtgctctaaagaatccctttgggaatgctggcctcctgctaggagaggcaggcaaacagctgaggcgggtaggcttagggccagagccaggggagggcagggtggtgtatggcaactaaccagtcattctccctcttcctctcaggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgaggggctccaagatccctgatgtgtggggcacccccacggggccagagatgtagagaaatgtgctttgtagcacccttgttgttatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450897 - DNA, 3855 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgaggtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgaggtgagactcggggctgccaagctcaggtgagggctggaggtgcaggcccaacccctccttccctctccccaggctgcgctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcaaaaaaaaataaaagtgcaccaagactagaagg

SEQ ID NO: 450898 - DNA, 3443 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgagctgcagctcaggatcacgagacggcatgcacgctttctgtctaaccgagccctcaagcgggtcagatgcagcctccatccgaaccttttctttcccagcca

SEQ ID NO: 450899 - DNA, 3248 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggcgttggatgcagtcagcggcgttggatgcagt

SEQ ID NO: 450900 - DNA, 3076 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcgtgagacaccgaccagcttgaacacgcgac

SEQ ID NO: 450901 - DNA, 3069 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctctcaagagcacttactgcctcgcaaataataaaaatttctagccagtca

SEQ ID NO: 450902 - DNA, 302 bp, Homo sapiens
gtgggaatgttcaaaggccagctcaccacagatcaggtgttcccatacccgtccggtaagggaagggataatcagagctgggtggggccagggtggtttcccctgccagcctggcctgaccagcctgtcccccaccctctgcagtgctcaacgaagagcagacacagtttcttaaagagctggtggagcctgtgtcccgtttcttcgaggtaaggaatgactcggggcttggtccctggtgaggtgtttggagatgttaagctcaaaaggagcctggatgtgggatcctgtgccttccccag

SEQ ID NO: 450903 - DNA, 560 bp, Homo sapiens
atcccccgcgctgcaggacattcggcaccaggccaagctgataaaacacaagaagggcattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcaacacctttcatacaaaaaaacctcgagctcgtcccc

SEQ ID NO: 450904 - DNA, 557 bp, Homo sapiens
  misc_feature (557)..(557): n is a, c, g, or t
actagttctagctcgcgatctagaactaggtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgcttcacgaagagcagacacaagttcttaaagagctggtggtgggtcaccagcccacttggcttctgtctcccggccgn

SEQ ID NO: 450905 - DNA, 3729 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggtaagacagagaattgggtgggggtagaggtggggaggacagtgagtcctgactgctggaccctcttcccccatagggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450906 - DNA, 3892 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggtaagacagagaattgggtgggggtagaggtggggaggacagtgagtcctgactgctggaccctcttcccccatagggacaaaggaaaggagctctctgggcttggcagtgctctaaagaatccctttgggaatgctggcctcctgctaggagaggcaggcaaacagctgaggcgggtaggcttagggccagagccaggggagggcagggtggtgtatggcaactaaccagtcattctccctcttcctctcaggcgggcagggctgggcagcggcctgagtctcagcggacttgtccacccggagttgagtcggagtggcgagctggtaagcggccaggggtccaggagagcctgcatcagggactgcaccgatggcccctctgagccccgcactgtccccatctcttaaggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450907 - DNA, 3684 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcaaaaaaaaataaaagtgcaccaagactagaagg

SEQ ID NO: 450908 - DNA, 494 bp, Homo sapiens
atacggctgcgagaatttacagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450909 - DNA, 3823 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgaggtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgaggtgagactcggggctgccaagctcaggtgagggctggaggtgcaggcccaacccctccttccctctccccaggctgcgctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450910 - DNA, 3453 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcctggttgtcccgaaggggcctagtgtacccacgcaggggtgatgcccttgctttc

SEQ ID NO: 450911 - DNA, 3503 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcagctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450912 - DNA, 3816 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggtaagacagagaattgggtgggggtagaggtggggaggacagtgagtcctgactgctggaccctcttcccccatagggacaaaggaaaggagctctctgggcttggcagtgctctaaagaatccctttgggaatgctggcctcctgctaggagaggcaggcaaacagctgaggcgggtaggcttagggccagagccaggggagggcagggtggtgtatggcaactaaccagtcattctccctcttcctctcaggcgggcagggctgggcagcggcctgagtctcagcggacttgtccacccggagttgagtcggagtggcgagctggtaagcggccaggggtccaggagagcctgcatcagggactgcaccgatggcccctctgagccccgcactgtccccatctcttaaggcagtacgggctctggagcagtttgccactgtggtggaggccaagctgataaaacacaagaaggggattgtcaatgaacagtttctgctgcagcggctggcagacggggccatcgacctctatgccatggtggtggttctctcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtca

SEQ ID NO: 450913 - DNA, 3772 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgaggtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcaaaaaaaaagtcgacgcggccgcgaat

SEQ ID NO: 450914 - DNA, 3253 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcagtaagtgagctctacaccattccgcccctccctttcctctccttgagactaatgccccca

SEQ ID NO: 450915 - DNA, 3408 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcgggtgaggtcccaggcatgctgggagggagtccagtttgggtgctcagctcccaaaaccagtctcatctgttctttgtccctaggaggcagcctggaaggtgacagatgaatgcatccaaatcatggggggtatgggcttcatgaaggcttcatgaaggtacaggacggtcttctgcagagcctcggctgggccaggggtgggtaggcacatctcagcacgggcatataatttgtgtggccctgtgctagaacctggagtagagcgtgtgctccgagatcttcgcatcttccggatctttgaggggacaaatgacattcttcggctgtttgtggctctgcagggctgtatggtaagacagagaattgggtgggggtagaggtggggaggacagtgagtcctgactgctggaccctcttcccccatagggacaaaggaaaggagctctctgggcttggcagtgctctaaagaatccctttgggaatgctggcctcctgctaggagaggcaggcaaacagctgaggcgggtaggcttagggccagagccaggggagggcagggtggtgtatggcaactaaccagtcattctccctcttcctctcaggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcagtaagtgagctctacaccattccgcccctccctttcctctccttgagactaatgccccca

SEQ ID NO: 450916 - DNA, 2556 bp, Homo sapiens
cgcctctgcctctctgcccagataataagcaggccatggcggctatctacttttcttgagctgtagcgcaagtagttcccttgccatgtcaccaccgatcaagtgtgccacattagccggtccgttgcttctactaacttatgtactcacccaggcatccctataaatgagtcgtcgcgttagagaagtactgatatcgcctctctctacgaaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctgggtgcctgtgggatggatgttaactgtccaaacataacacaatttacatgcagtcccctaggcctgagccatgggcctcaccctggttcccaagtccttacaaatctctaagttggggattgcctaacaatagactgactagtagcaagtcaccctcctacctagacctaagacagaccagcattctctgctgtgccctttgcacaccccacttcttttctacacactggggatggcccaggtcaggcactgccctaggccaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatcacagtgtgctggttgggacatgcaaaagaactggatactcccaggtgttaagggggaactgcctgctggagggatggggaagtgggccgaggggactttgaagctcatcagaacttggggtaaagtagctctctccccaacagggagactgtggccgctttctgtctaaccgagccctcaagcgggtcagatgcagcctccatccgaacctctgctgtgcccagcccctgtggaaaatactataccctcaatggaagcaagctttggatcagcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgaggtgagggcctcccaagcccctctccctggagccctggggctttc

SEQ ID NO: 450917 - DNA, 763 bp, Homo sapiens
tctcttcccacctccgtggcattctaattacttctcccttctcctttacaaagatgggggtgccctctctggattggttttattcctctcctctcccaggaggaccagcccaggcacagacgctgtcctttgagaattttctctgcttttccgttcaagggctggttgcagggagggagctcaggcagagacttttcatttaagaactcttttggctaaggcctgcaggggattcccagcatctgaaatattagcactggagctgatccctactcaggtgaaattcctttactggacaccacaagaatgtgtcagaacaggttccctgtgcaaggggcttcaaaaccaaaatattcccactgcgctctttacgctttttaaaccaccgggagggggcaaaagacataactgggttgttaactattcatttcaccgtgtaaaaaaaaatgtaggtgtttcttctgcttttggtttgatgtatccatccatttgcttattccaccccctccaaaaaagggacttcaccttcctactagtgtatctaaattgtttaagtgaatcagagtgagatggtttactctgaaaggtgctggactttacagactgaccattgattttgtacacagagtcctacttagtaattgtagccactgtctgttgctccaatgactttagttggcagccaccatcctgtaggatgtttttcgggcaacattacctgaggtactttagaaatattgtagttttgaatgtcaaaaaaaaa

SEQ ID NO: 450918 - DNA, 516 bp, Homo sapiens
gtgtaaaaaaaaatgtaggtgtttcttctgcttttggtttgatgtatccatccatttgcttattccaccccctccaaaaaagggacttcaccttcctactagtgtatctaaattgtttaagtgaatcagagtgagatggtttactctgaaaggtgctggactttacagactgaccattgattttgtacacagagtcctacttagtaattgtagccactgtctgttgctccaatgactttagttggcagccaccatcctgtaggatgtttttcgggcaacattacctgaggtactttagaaatattgtagttttgaatgtcaaaaaaaaaagagacatatcaagagatgattcttagagcagggctaatgtgttagaattgagtgctaaaaatagccaagacattaacaccatttggggagtaatcatcagataattttccatgaaacatatactttatgaaaatctaagtttagcttcgagaccaatgtagagacaattcagcctcttttgcgggg

SEQ ID NO: 450919 - DNA, 690 bp, Homo sapiens
  misc_feature (29)..(29): n is a, c, g, or t
ctgctctagagcatccccccgatgaaganggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450920 - DNA, 528 bp, Homo sapiens
ggcccctcaggctctcagcttcccatcttctctaagacatgtctgctccatcattctggtgtctctctcttccctccttcctggcacctgacacgtttgttaccccacttgtggggtgttgctgtctgatcaccatcttccttccaagggtaggggaaagggccctggctggttcaagtcacagctctgtcctcagcgccaggcacagtgcccagctcactggcacagcctcagattccctggacacctggctccccggctgcattttttaccattgggataagttattagtaccattgaaaattaatacctggggattctcttaatattgttcatattcatgttcttctcagcagttttaccatgaggaatctgtcttaaacaatgtcagttgtcaatagcgttatttaaaatagcaacaacaataaaaagcatacattaaatatagtaaatgcatagttcagccaagaatcaaagatgcagaagtactatgcatttatttgtgtattccgtgatagaggtgaaagt

SEQ ID NO: 450921 - DNA, 6492 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450922 - DNA, 6706 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaaaaaaaacaaaaaaaattcccggggacatacatttggtcgggggcgccggaccacagcgggctcttggcaatctgggcccttggggccctacaggtggtttccttgaccccaggtcttcttggtgcccaagtgggcatatccggccggtcccccaaaaaagggcccggttaaattcggaaaacccgggtacctggcttagttccgccggagacgg

SEQ ID NO: 450923 - DNA, 6582 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttctttttctcgctgtcctctctgtggccaccctcctttttctcacttctgctctccctgtccggctcttctctctcctctctcccttctagcagattctctggctgtttcctctcctctccctctgtgctcctccctcctcctctctcctcccggccactatcctctctcttcaccctcttctctttctgtctcatgtctcctcctagctcttttccttcccagttcctagctctctcctttctctttcctcttctctgctgatacatggaccagctca

SEQ ID NO: 450924 - DNA, 6213 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaaaaaaaaaaataaaaaaaaaaaaaaaaaaaaaaaaaagcgggaggataaatgggggggggggaaaaaagggtaaaaaaagggaaggggtaaggtttcgggacccttttggaaaaggggaaaggggggcccaaagggggagaaagaaagcgggacga

SEQ ID NO: 450925 - DNA, 5726 bp, Homo sapiens
tggggaaggccacagtgtcgcgaggccgtggcagcggcggcccccgcggagcggcggggtgggtggggggcccgggccgcgtggaggccgcgcgatcctctccgcgcgcgctctcgccggggtcgccggacaaagctcgcccccctcgcccggcacccctacagtcgccctcccaattacagcggctgcaacaataggcaggcgttggggcttttctggctgcgtggtaacgggtccgacccgaatgttgcgtttttggcgaagctgcgatcggggctcagccaaacctccagatatgtccggcgtcggccggacacgggcattagcggtccccttgggctagccgacctcaaattgtcttaaaaacgtgtcattccagattttcaaggaaagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450926 - DNA, 6044 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450927 - DNA, 4249 bp, Homo sapiens
gtaatgtgtacccagctaatcactggaactcgacctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450928 - DNA, 4248 bp, Homo sapiens
gtattagaggatcccaccaacattggactcgtccctgtgagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450929 - DNA, 3987 bp, Homo sapiens
tcgcgcagggtatggcctgctgcgcttgtaggccttagcattgtagggctgtgtagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450930 - DNA, 3715 bp, Homo sapiens
  misc_feature (10)..(12): n is a, c, g, or t
  misc_feature (15)..(16): n is a, c, g, or t
  misc_feature (41)..(41): n is a, c, g, or t
ggaaaaaccnnnaannctaggctaggtacgaggctgggtgntgagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450931 - DNA, 5643 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgctcctgtgccagaacgcacagaccttcaacctggagggctccctggtgagggcaccgctgggggttggggatgggccactcccacagctgggctttgacccaacccgcccctccttcccttctgaattgatgggttaaaaacaagtcccgctagctgtggtggttcgtgcctgtaatcccagcactttgggaggccaaggcgggaggatcacttgagaccaggagttcacgaccagcctgggcaacata

SEQ ID NO: 450932 - DNA, 2681 bp, Homo sapiens
tgatgcaataaaagacctattgatttggaaaaaaaaaaaaaaaaaaaaaaaaaaactgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450933 - DNA, 2731 bp, Homo sapiens
  misc_feature (10)..(12): n is a, c, g, or t
  misc_feature (15)..(16): n is a, c, g, or t
  misc_feature (41)..(41): n is a, c, g, or t
ggaaaaaccnnnaannctaggctaggtacgaggctgggtgntgagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450934 - DNA, 2385 bp, Homo sapiens
caaggacggctacatgatatgctacaacagaaacagcagcgcgtcgtttaataatcacgtactgggcccacgttaaaccttagtaaagcgagtaccgttaatgtgtcagacgcagtgccatgtggctgcgcagaaatttcgagcgacgcaagtgccaaagcaccggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450935 - DNA, 2259 bp, Homo sapiens
aacttagctagtacgaggctggtgttaatcggccgaggggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450936 - DNA, 5005 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggagcgcatggcgcgacggaggcccgcaccgcagctggggatactctagaa

SEQ ID NO: 450937 - DNA, 4938 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagttgtacttggctgcagctaggatcttctcctccacgctgttgacggtgcagaggcggagcacacgcacctcga

SEQ ID NO: 450938 - DNA, 1752 bp, Homo sapiens
gtgacacgtgcctgtagtcccagctacttaggaggctgaggtgggaggatctcttgagccctgggagttcaagactgcagtgagctatgatggtgccactgcactccagcctgggcaacaggtcgagaccctgtctctaaaaataaataagtaaataaaagaaatagatggggagagtgtggaacagaggtgtcaacatcacctccgggtgaagggatttcaggagcacgttcttttctgtacagagaagatagttctttttttttggtcaagaaattcaaccattagttttttaaagacaagcttgggtggggtgcctgctgggggcagtgctggtctttcactgcagcccaggcaccccttgagagtcccagtgtgtgttatgccccgagccagtcaagctgaagggagagcgggtgcgggggccctcctccgtgtcccagcccggcccctgggattgcgtcgcggcctctgcttgtcgacctgggtgctggctgtcctattttactactattgaccctgccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450939 - DNA, 2282 bp, Homo sapiens
ggcccctcaggctctcagcttcccatcttctctaagacatgtctgctccatcattctggtgtctctctcttccctccttcctggcacctgacacgtttgttaccccacttgtggggtgttgctgtctgatcaccatcttccttccaagggtaggggaaagggccctggctggttcaagtcacagctctgtcctcagcgccaggcacagtgcccagctcactggcacagcctcagattccctggacacctggctccccggctgcattttttaccattgggataagttattagtaccattgaaaattaatacctggggattctcttaatattgttcatattcatgttcttctcagcagttttaccatgaggaatctgtcttaaacaatgtcagttgtcaatagcgttatttaaaatagcaacaacaataaaaaaaggtggtcagacctggcagcttgtgcctgtaatcccagcacttggagaagccaaagcggggggatcatttcagctcaggagtttgagaccagtctggccaaaatagcaagacctttgtctctattaaaaaaaaaaatgccaggcacagtgacacatgcctgtaatcccaagcactttgggaggccgaggtgggcagatcacctgaggtcaggagctcaagaccagcctggccaacatggcaaaaacccgtttctactaaaaatacaaaaattagccaggcatggtggtgggcacctgtcatcccagctacttgggaggctgagtcaggagaatcactggaacctaggagttggagtttgtagtgagccaagatcgcaccactgcactccagcctgggcgacagaatgagaccctgtctctgaaaaaaagggaaatgacctaaatgcccaagaacaaggggaggctaaattagggcacgttgtgcactgaaacactaaacagacattaaaaaattttgttgtagaaaattacaggaaaagatatccatgacacagccagcagtgtggcacgtgggctacaattccagcgtggccttcagttctgcacacgtgcgtcaaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450940 - DNA, 3509 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagtaaggggtcccgacacaggttgttctgtgccagcttcctgtgaggtggcgctggtgggagtggctagaatcccagccatccctagctgacattcagcactgtccagccagctgctactgtggaactacagagaccaaatttatttacttcacatttcatgtattttatagggatttaatagagcaattgcattcgcatggttcaccatatgcttacgaggtacagtcaggtgtgcgggagaagccctcctcaccccgttctctgctccccggctccctccctttccactaccct

SEQ ID NO: 450941 - DNA, 1578 bp, Homo sapiens
ggcccctcaggctctcagcttcccatcttctctaagacatgtctgctccatcattctggtgtctctctcttccctccttcctggcacctgacacgtttgttaccccacttgtggggtgttgctgtctgatcaccatcttccttccaagggtaggggaaagggccctggctggttcaagtcacagctctgtcctcagcgccaggcacagtgcccagctcactggcacagcctcagattccctggacacctggctccccggctgcattttttaccattgggataagttattagtaccattgaaaattaatacctggggattctcttaatattgttcatattcatgttcttctcagcagttttaccatgaggaatctgtcttaaacaatgtcagttgtcaatagcgttatttaaaatagcaacaacaataaaaaaaggtggtcagacctggcagcttgtgcctgtaatcccagcacttggagaagccaaagcggggggatcatttcagctcaggagtttgagaccagtctggccaaaatagcaagacctttgtctctattaaaaaaaaaaatgccaggcacagtgacacatgcctgtaatcccaagcactttgggaggccgaggtgggcagatcacctgaggtcaggagctcaagaccagcctggccaacatggcaaaaacccgtttctactaaaaatacaaaaattagccaggcatggtggtgggcacctgtcatcccagctacttgggaggctgagtcaggagaatcactggaacctaggagttggagtttgtagtgagccaagatcgcaccactgcactccagcctgggcgacagaatgagaccctgtctctgaaaaaaagggaaatgacctaaatgcccaagaacaaggggaggctaaattagggcacgttgtgcactgaaacactaaacagacattaaaaaattttgttgtagaaaattacaggaaaagatatccatgacacagccagcagtgtggcacgtgggctacaattccagcgtggccttcagttctgcacacgtgcgtcaaaggtggggagagttctgttggtggtggcgctgagggctgcacaacactgggacgtgccttatgcccctgaactgtgtactaaaacatggctgctttggtaaattttatgttatatatgatttataatatatttttttaaatgcccagctactcaggaggctaagatgggaagatcacttgagcccaggagttaaagtccaaccagggcaatgtagcaagaccacatgtctaagaaaatttaaaaatcggctgggcgcggtggctcacgcctgtaatcccagcactttgagaggccgacatgggtggatcacgaggttaagagattaagaccatcctggccaacatggtaaaaccctgtctctactaaaaataccaaaattagctggacgtggtggtgggcgcctgtagtcccagctactcaggagggtgagggaggagaatcgcttgaaccaggaaggtggaggttgcagtgagctgagattgcaccactgcactccagcctggtgacagagcgagactgcgtctcaac

SEQ ID NO: 450942 - DNA, 633 bp, Homo sapiens
atcctcctgcctcagcctcccaaagtgctgggattacaggcatgagccaccacgcaggcctggtttttgtatttttaatagacacagggtttcgccatgtcgcccaggctagtctcgaactcctgagctcaagccatccacctgtctcagcctcccaaagtgctgggattacaggcatgagccactgctcctggccgcctagttaatttttcttctagtttttgtagaagtgaggtctctccatgttgcccaggttggtctcaaactcctgggcttgagcaatcctcccaccttggcctcccaaagtgttgggattactggcgttaagccaccacacccagccaagagtgttatacttctgaatgactcctaagacgtgtgtgtggtagaggggaggcaagctggaggtccgagaggaccccctggatagatgtccagaagtgatcaccttctgtcctgtgctcgccctgcccgggggcacctgctagacgtcccctgcacacacggactgggtgtgtaaggcacttacaatgctcctttagcggtgaagcatgtgacatcaccatacgtgtttgtcattgtggatgccacagagctgtgcagtgcgcgggcttgtcctcttccctcctacag

SEQ ID NO: 450943 - DNA, 676 bp, Homo sapiens
ctgttgtagggattgaaaagcactcataggctcacatagctcacaataggttagagcacaaaatcccacttcctgtcagggggccaggtgcctgtgcgggctctcctggccacatcaggaggggccgtgggcttggggttgccccccggccccccatcatggctctgggttttcaaggcctgctgcagccacacccctgggcccagttcccacagcaagacccatggactcggggtccccggctgcagttgtccctcttggctctttgtttcctggctggctgtagagaggcccccagaagatggctggggggccctttctggcccagtaaccctctggtatctctgcctggtgcttcctctcattgcccaggtctcccctcttctccccagctgtgagggtctcctcacccacaccccagtgtgctctggtcagagctcatatgacagggccgagggggtcagagctgggttcggatggggggagtcaggcctcaagccaccttgggccctcgtgagcattatgtgtcccctgcaggtggagtacgtcatcaagtgcgacatgtctgcgctgcagcgagtgctctaccgccacatgcaggccaagggcgtgctgctgactgatggctccgagaaggacaagaaggtgggccccagagtcccccaactgcattccc

SEQ ID NO: 450944 - DNA, 847 bp, Homo sapiens
aacttagctagtacgaggctggtgttaatcggccgaggccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggccaaatgcctccccaggacctcgggcgtgccccggatgcaggcagctctggagggctccagcctgctgagaccagggatgttgtgcccgagcctcaagttc

SEQ ID NO: 450945 - DNA, 6393 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450946 - DNA, 6469 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcgtctcgcccttttgcccaggctagagtgcagtggtgcggtcatggttcactgcagcctcaacctcctggactcagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450947 - DNA, 6489 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaaaattacaggaaaagatatccatgacacagccagcagtgtggcacgtgggctacaattccagcgtggccttcagttctgcacacgtgcgtcaaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450948 - DNA, 6027 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450949 - DNA, 5375 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccaaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450950 - DNA, 3771 bp, Homo sapiens
gcggccgcctactactactactactgctcgaattcaagcttctaacgatgtacggggacatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450951 - DNA, 3565 bp, Homo sapiens
gattcgccggtgttatagaggatccccatggcatgtcgtgaggataccattgaccataagcgctgactgcttgtccactctctcagtgacagcatgggccacggcatagtaggactgcaggccacgtgcatgagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450952 - DNA, 2949 bp, Homo sapiens
ttagatcttaggactacaggcgcatgcacatgcagctattattgtgtagagaggagatctagacatgttgcccaggctggtctcgaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450953 - DNA, 5785 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaaaattacaggaaaagatatccatgacacagccagcagtgtggcacgtgggctacaattccagcgtggccttcagttctgcacacgtgcgtcaaaggtggggagagttctgttggtggtggcgctgagggctgcacaacactgggacgtgccttatgcccctgaactgtgtactaaaacatggctgctttggtaaattttatgttatatatgatttataatatatttttttaaatgcccagctactcaggaggctaagatgggaagatcacttgagcccaggagttaaagtccaaccagggcaatgtagcaagaccacatgtctaagaaaatttaaaaatcggctgggcgcggtggctcacgcctgtaatcccagcactttgagaggccgacatgggtggatcacgaggttaagagattaagaccatcctggccaacatggtaaaaccctgtctctactaaaaataccaaaattagctggacgtggtggtgggcgcctgtagtcccagctactcaggagggtgagggaggagaatcgcttgaaccaggaaggtggaggttgcagtgagctgagattgcaccactgcactccagcctggtgacagagcgagactgcgtctcaac

SEQ ID NO: 450954 - DNA, 2255 bp, Homo sapiens
  misc_feature (71)..(71): n is a, c, g, or t
gccctacatgttccagcacatcgaggagtggttgcagatcttccgcagctgcatgatggtgttcatcaggntcttggtgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450955 - DNA, 5153 bp, Homo sapiens
  misc_feature (5106)..(5106): n is a, c, g, or t
  misc_feature (5135)..(5135): n is a, c, g, or t
  misc_feature (5150)..(5150): n is a, c, g, or t
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatgactggacgcagccgagagccgcacccacgaacccctctgaaagacactccctgtctcngaaccgagtgacgtacttagagagagaanttcgctgtccccccngat

SEQ ID NO: 450956 - DNA, 4914 bp, Homo sapiens
tccctaagtgctgggattacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggtaaaagcgggccgggccccaggtcgaggagaaggaagggggtgcctgcaaaacctcgaggagacggccctggcttgagggtcctccagcctcctccacattgtcttggaccccaggagccgggaggagctgcacccatatctccataggtcatcagggagaaaagaggcggggtcctcctgtttcccaaaatacaaacagcctttccctctgattgggaaagcagtgtataagccatccgtcggtttggtttttcttaaatcttggaatggcaccc

SEQ ID NO: 450957 - DNA, 1401 bp, Homo sapiens
gaccctacatttggagcagcatgagccagtaagggtgagccctcccaaaactcatgtcatcacacacttaaagacacaattatgccttcccaacagtcccccaaagtcttaactcattccagtattaactcaaaagtccaagtccaaagtcccatctgagacaagcagtggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaa

SEQ ID NO: 450958 - DNA, 254 bp, Homo sapiens
gcccttggtgggttttgaggaaatgattcctgaatgaggagtcgattgccgtgtgaagggctggtggcacggcacccgcgtgagctacgcgtgccctcagtgcgcttctggattgactggccatgggtgctcacagacatgcacattgtgccaccacattgcagtaacccccatgcttttgtaggctgaagatgaggaggggtaccgcaagctcatcgaccagaagaaggacaagcgcctggcctacctcttgc

SEQ ID NO: 450959 - DNA, 2106 bp, Homo sapiens
  misc_feature (1338)..(1338): n is a, c, g, or t
catatttgtgtaaaattttactgctttcatttgtttttctttaaatagaccatctttaatatatatgcattctttttttttttaaaaaaaagaagcattttaaaaaaggaaacatttcccttattatcttgtcacttgccaaaaatagaaggtaacttaaaaataaatgcaatcaaaccaaaacgatgccattacattctagctagagttgtatcataatatctcacaaaagagattgtgaagcagagcagatgtgttaaaacggagatgttctacttggtgtgtcaaggatttaaagacttggaaaagaaagaattatctcactatgtaagttaatatcatttgacaacctcacctatcaaattacctataaaccaccctatgtcatcttatgggccactgctggtaagagtcccagacattgggaaacaacgtggtcagaaactttcaacatgaagctttcaatatgatcaagctggatggttgcgggtgggagaggtatgaagcagtcatcaaacaagacatgctttttggctgaaattcagtggtatttttgttaccaggattcttagttttcagaatgaggtaccaaatgtatttttgcaatgttttaattcccttccttaggtaattcttagtgacttatttgggcaacattagtgttgctatatagaataagtttcattttagatgacgtggtctttctgtgtctgttgtgctcttcgaatgacccattaagcacattctaggtttcagcaattgatttgtgtgattttctgaccaaatggctcaggtaattggaaattgagtagactctgattttctctctttgaggaatattcactcttccctataaaacaatcgggtctttctcttccattattctttcaaggaattggttgtcaatcttctcttcattcttgccagcctgtagattttgaaaccaaaagagcctatagcttgaaggtagaggcagccaacgtgcacatcgacccgaagtttatcagcaatggccctttcaaggacactgtgaccgtcaagatcgcagtagaagatgctgatgagccccctatgttcttggccccaagttacatccacgaagtccaagaaaatgcagctgctggcaccgtggttgggagagtgcatgccaaagaccctgatgctgccaacagcccgataaggtacagacggatttattttaagagcttggatggggaattttagagtcaagaggttctgggaaagccctgtaggaaccacgtttttcaatttcaaaaagggttcaagtttatcaggttcaatagaatgtaaacaagattaagatttagaagacatgancttcccttcacctctgttcctgactttttggataggattgttcaagctacatgactttgctctggagcagattcccccaggcatactaggtgacggagccctgagctgggcctgtctgcctcaggggactgtggggaaatataaataattattgtgaaataattatagtaattgcaatttattaaataccttcccattctctggttactctatgaggaggttaggtatgtgatctaatcaatcccctcaacttaatcgatgtataaattgctagtccttaaaatgagaggaaattggaggcaatgcaagacaaagtgacttgcctggaatgatacagccaccgagcaggaggcaaggaaagccagctctgtctaactgctgctgagtactttgtaaaagtagtaaagtgtccaaataaatttcaggtgattttattattatgaatacctttttttgtgacaaaaaatgtgatccagaactgtggctgggcaccgtggctcacatctgtaatctcatcactttgggaaggctaaggcgggtggatcacctaaggtaaggagttcgaacccagcctttacaatgtaatgaaaccctgcctctactaaaaatacaaaatttagctgggcatggtggcatgcacctgtaattccagctcctcaggaggctgaggcaggacaatcgcttgaacccgagaggcagaggttgcagtaagccgagatcaagccactgcattctagcctgggtggcagagtgagaccctgtctcagg

SEQ ID NO: 450960 - DNA, 233 bp, Homo sapiens
gtcgctctagaggatctccttggaacgagagacgccctatttctatgtcatttttaatgtatctatttgtacaattttaaagttcttattttagtatacatataaatatcagtattctgacatgtaagaaaatgttacggcatcacacttatattttatgaacattgtactgttgctttaatatgagcttcaatataagaagcaatctttgaaataaaaaaagattttttttt

SEQ ID NO: 450961 - DNA, 299 bp, Homo sapiens
gtcgctctagaggatctccttggaacgagagacgccctatttctatgtcatttttaatgtatctatttgtacaattttaaagttcttattttagtatacatataaatatcagtattctgacatgtaagaaaatgttacggcatcacacttatattttatgaacattgtactgttgctttaatatgagcttcaatataagaagcaatctttgaaataaaaaaagattttttttttctttttatatttattttttattttgttattttgtgttttgtgtttttgttgttgtgtcttatgtg

SEQ ID NO: 450962 - DNA, 3691 bp, Homo sapiens
tccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatcgcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacatataaatatcagtattctgacatgtaagaaaatgttacggcatcacacttatattttatgaacattgtactgttgctttaatatgagcttcaatataagaagcaatctttgaaataaaaaaagattttttttt

SEQ ID NO: 450963 - DNA, 3803 bp, Homo sapiens
tccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatcgcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacatataaatatcagtattctgacatgtaagaaaatgttacggcatcacacttatattttatgaacattgtactgttgctttaatatgagcttcaatataagaagcaatctttgaaataaaaaaagattttttttttttttttttttttttttttttttttttttttttttttaaaagggccccagtaagggggggggggggggttataaaaaaaaggggaaaattattttttctacaggggggaaga

SEQ ID NO: 450964 - DNA, 3140 bp, Homo sapiens
catatttgtgtaaaattttactgctttcatttgtttttctttaaatagaccatctttaatatatatgcattctttttttttttaaaaaaaagaagcattttaaaaaaggaaacatttcccttattatcttgtcacttgccaaaaatagaaggtaacttaaaaataaatgcaatcaaaccaaaacgatgccattacattctagctagagttgtatcataatatctcacaaaagagattgtgaagcagagcagatgtgttaaaacggagatgttctacttggtgtgtcaaggatttaaagacttggaaaagaaagaattatctcactatgtaagttaatatcatttgacaacctcacctatcaaattacctataaaccaccctatgtcatcttatgggccactgctggtaagagtcccagacattgggaaacaacgtggtcagaaactttcaacatgaagctttcaatatgatcaagctggatggttgcgggtgggagaggtatgaagcagtcatcaaacaagacatgctttttggctgaaattcagtggtatttttgttaccaggattcttagttttcagaatgaggtaccaaatgtatttttgcaatgttttaattcccttccttaggtaattcttagtgacttatttgggcaacattagtgttgctatatagaataagtttcattttagatgacgtggtctttctgtgtctgttgtgctcttcgaatgacccattaagcacattctaggtttcagcaattgatttgtgtgattttctgaccaaatggctcaggtaattggaaattgagtagactctgattttctctctttgaggaatattcactcttccctataaaacaatcgggtctttctcttccattattctttcaaggaattggttgtcaatcttctcttcattcttgccagcctgtagattttgaaaccaaaagagcctatagcttgaaggtagaggcagccaacgtgcacatcgacccgaagtttatcagcaatggccctttcaaggacactgtgaccgtcaagatcgcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacatataaatatcagtattctgacatgtaagaaaatgttacggcatcacacttatattttatgaacattgtactgttgctttaatatgagcttcaatataagaagcaatctttgaaataaaaaaagattttttttt

SEQ ID NO: 450965 - DNA, 3868 bp, Homo sapiens
acaggcccgcgacgctcccctcagctggcggcggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatcgcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctgggttgcccaagcttaatggaacccccctctcccagggaagacatgagattgctttatctgggcttccagctgatgctattttcctatgttaaagtaaacagaagattttgtcttctgggggtctttataaaacttcctttcctctatgtggtggctacagagagtccaaccacacttacgtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacatataaatatcagtattctgacatgtaagaaaatgttacggcatcacacttatattttatgaacattgtactgttgctttaatatgagcttcaatataagaagcaatctttgaaataaaaaaagattttttttt

SEQ ID NO: 450966 - DNA, 3824 bp, Homo sapiens
tccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatcgcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacatataaatatcagtattctgacatgtaagaaaatgttacggcatcacacttatattttatgaacattgtactgttgctttaatatgagcttcaatataagaagcaatctttgaaataaaaaaagatttttttttttttttttttttttttttttttttttttttttttttttttttttttttttttttttttaaaagggccccagtaagggggggggggggggttataaaaaaaaggggaaaattattttttctacaggggggaaga

SEQ ID NO: 450967 - DNA, 318 bp, Homo sapiens
cttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggtgcgtacggtgtgggaggcctg

SEQ ID NO: 450968 - DNA, 749 bp, Homo sapiens
atgcctgacatatagtaagtgctcaataaatatttgttgcctgcctaagatactcattcaaaagtcatagaactagtctgtccctttgatgttgtttcaatctataggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggtaggtaatgccatatgtttgtcaaaggatattttcttagccttaccactgctccaatttggtggcctagaaagatgtatttcattgcagtgagtgcctaatggcatacttttcaaagtatcacactaaagtttcaggttatgtattttccattcttggaccaggtaagcctccaccctacccatgcccctgcttttaaaaaaaaaaaaatcatgattcacagccgggcgcagtggctcatgtctgtaatcccagcactttgggaggccaaggcaggtggatcacctgaggtcaggagttcgagatcagcctggccaatatggcaaaaccccgtctctactaaaaatacaaaaattagctgggcgtgctaatttacaggcgcacgtgtaattccagctactcgggaggctgaggcagaagaatcacttgagccccggaggcaaaggttgcagtgaatagagattgcaccactgcactccagcc

SEQ ID NO: 450969 - DNA, 724 bp, Homo sapiens
  misc_feature (31)..(31): n is a, c, g, or t
  misc_feature (579)..(579): n is a, c, g, or t
  misc_feature (596)..(596): n is a, c, g, or t
  misc_feature (601)..(601): n is a, c, g, or t
  misc_feature (606)..(606): n is a, c, g, or t
cgcgaaccataggcagtacgaggcgggtgtngtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtaaacaaaaaaaaaaaaacaaaaaaaaaaaacaaccccgggggcctttnttggcgggggggggaanaaggnggttngaaggggccccgcggggcaaaagggtggtcccggccccagtttttttggcaaagggggaaaactcggcgggcccccaaagaggggcggcgaaaaatcgggaagaccggggaacccgtg

SEQ ID NO: 450970 - DNA, 562 bp, Homo sapiens
  misc_feature (417)..(417): n is a, c, g, or t
  misc_feature (434)..(434): n is a, c, g, or t
  misc_feature (439)..(439): n is a, c, g, or t
  misc_feature (444)..(444): n is a, c, g, or t
aattcaagcttctaacgatgtacggggatttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtaaacaaaaaaaaaaaaacaaaaaaaaaaaacaaccccgggggcctttnttggcgggggggggaanaaggnggttngaaggggccccgcggggcaaaagggtggtcccggccccagtttttttggcaaagggggaaaactcggcgggcccccaaagaggggcggcgaaaaatcgggaagaccggggaacccgtg

SEQ ID NO: 450971 - DNA, 826 bp, Homo sapiens
agaccccaatggagggttcttagatttccagcaagaaagaattcgaggtgaatccatagagtgagagcaagtttataaggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggcagaggtggaacgcacgatagagcaagaacaagcaaggagctacgcacacacagaaaacccaggagctgacaggacagactggaatcaggcctccagacggccgcacactccagaacatgccaggctgcagctccacacagcaagcccgcgacgcgagcacagaaaccccctaccagagccatcaactaagacacttgcgccactgaaacagcgacaaaggacaccgcaggactaacggggacgacagaacctgctgccacgtggcacgcaccacagacacagcggcatgtcctcggaaaacccgcgaaccctgggca

SEQ ID NO: 450972 - DNA, 506 bp, Homo sapiens
ccaaaccaaaagagggaatagacaaagcacttggaaatttaaaatatgataaagtaaaaattgtatttaaaaggtagtaagattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaactta

SEQ ID NO: 450973 - DNA, 426 bp, Homo sapiens
  misc_feature (20)..(20): n is a, c, g, or t
cttaggctaggtacgaggcngggtgttgtgaaactactgcatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcgatctacggtgccatcgtccaccgagcgatctacagtgca

SEQ ID NO: 450974 - DNA, 665 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtaagtggttaattcagtaccaagtgatcaggaactagaggtgattcttagttacctaactgtgtgactctctgtgtattataagcattttgtataatatgtgttggcagtttttaaattctagccaagctccacagcacttctctcttcacacattaatgtgtgctgtgggactcaaattttcatttcagtgtcaagctaaaataagatggcaaatcatataatcctcaaattttgttatgcttttttttttgcttttttcttttcttttttttttttgaaatagagtcttgctctgtcacctaggctggagtgcaatggcacgatttgtctcactgctacctccacctcccgggttcaagcagttctcctgcctcagcatcc

SEQ ID NO: 450975 - DNA, 2430 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggca

SEQ ID NO: 450976 - DNA, 3611 bp, Homo sapiens
ctaacggctagtacgagccggggtaaatcggccgaggcctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450977 - DNA, 3649 bp, Homo sapiens
agaccccaatggagggttcttagatttccagcaagaaagaattcgaggtgaatccatagagtgagagcaagtttataaggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450978 - DNA, 3596 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450979 - DNA, 3732 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagcattaaatgtttccaagacaaattggaacaagaactactcaaatggaggagccaaggacagaaattgcaggtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450980 - DNA, 4029 bp, Homo sapiens
tctgaaggccctggagcccctcccgcggcccgggagggttgcggggcagttttgtcttgcggagggcagcgctgcagtgctgtgtggcagggtgggaggctcctcgggaagaagtgacacccctggcggcggcgagggtcttgaggcggcggctgccgccccacgggtcgtggcgtcccgtcccctcccgcgggcccaggctgtggtggttccgtaatccctcgcctggatgtcatcgccgttggcttcgaggcggaggtggagccttgttgcgtcaccctgagcaagttactttctttttgggcctcagtgtccccctttacgagtaggtttgatccctgaagcgccttgccttttgcatgctgcagctgtcggagaagacgttctaggcaggaggaaagacggtgtcgtgacctgcctctacagttaatccattgcccctccaccactgacccagcttagtttgggagctaatgttcccactcgtatattatttcaaccccactggacgtgttaactcttttctatcacttggattcttgcttcacatgcaagccaacaagtgaccatggttggagctgagtaaaatatggataatataacttattctattattggaaacaccattgcaagtaaaggactttatgtggtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450981 - DNA, 3125 bp, Homo sapiens
gaagacatcctggttgttaccactcagggagaggtggaagagattgacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450982 - DNA, 2776 bp, Homo sapiens
atcgcgagcggcgctcgcgatgactaggtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450983 - DNA, 3776 bp, Homo sapiens
cagatcagccaactcggggcggctgcactggtaggtgacagagataagggggcccaggaaagcaagaggtgcaaaggttagtggttcttagaccaagtccagaaaatggtacacccttgttaaggtgagaaagttatctttgcactaaaaagagggatgtagtgtatggccagaaactagcatgggggtccctggaaatactggccccaacttagccacaggtctcagggaaggtttttgtaactatcaagcaggtttctgtgcagactcagagagccctttcttatttctgccttttgaggaagtgaagcaggactagaagagccatcaggagccaacggggatgggaagcaaggagcctgcagtcagcattgtcactgggtagccccctctggcattactacctcagggtcggctagacatgcacagcagtttgggcaccagcattcaaataaaaaatcttggatgaaaaaccacaactagtaggcttagcttaagtgtgtttgtgaggtatgcacatgtgtatgtatgcaggtagaagatgggaagctctgaagcatgaaaccagttaggtcaacccatcacactgggttgcttatggccccagtctgagctccttgtatccttggacaaatgccttcctgtgttccctcttccttcatgtaacttgagccgagatgcctattctcacactgtaggaaggaatcacaccaacccaaacctaagtgcttcaggcttcgctgagtgagacgtttattcaaaacaaagattattgttttcatggttaggtgggattcaacaaggtttcatttatccctaattctgataagtcagtcttgagattttccccaaggttgctttttccctccttggtcacttataccctcagctaaaccaaaaaaaaaaaaaaaaaaaaaaattggcatcttgatgccagctcaggccttcaggtgtctttttaagtcactttaatttagcaccctgcccatagtaccatttcttcctcccagttgcgttctcctccatctcagtctccccgctttgcaatgccagattctctacaatttctcaccttgtacccagactgcaatatgtgatcctaatcctaattttttttattgttgacaggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450984 - DNA, 3479 bp, Homo sapiens
cctggagaggcacaggaggacgtgattccatcaggagccaacggggatgggaagcaaggagcctgcagtcagcattgtcactgggtagccccctctggcattactacctcagggtcggctagacatgcacagcagtttgggcaccagcattcaaataaaaaatcttggatgaaaaaccacaactagtaggcttagcttaagtgtgtttgtgaggtatgcacatgtgtatgtatgcaggtagaagatgggaagctctgaagcatgaaaccagttaggtcaacccatcacactgggttgcttatggccccagtctgagctccttgtatccttggacaaatgccttcctgtgttccctcttccttcatgtaacttgagccgagatgcctattctcacactgtaggaaggaatcacaccaacccaaacctaagtgcttcaggcttcgctgagtgagacgtttattcaaaacaaagattattgttttcatggttaggtgggattcaacaaggtttcatttatccctaattctgataagtcagtcttgagattttccccaaggttgctttttccctccttggtcacttataccctcagctaaaccaaaaaaaaaaaaaaaaaaaaaaattggcatcttgatgccagctcaggccttcaggtgtctttttaagtcactttaatttagcaccctgcccatagtaccatttcttcctcccagttgcgttctcctccatctcagtctccccgctttgcaatgccagattctctacaatttctcaccttgtacccagactgcaatatgtgatcctaatcctaattttttttattgttgacaggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450985 - DNA, 2006 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaagggtgcggctcgctgggatcctctagggtcggcgc

SEQ ID NO: 450986 - DNA, 2708 bp, Homo sapiens
  misc_feature (71)..(71): n is a, c, g, or t
  misc_feature (88)..(88): n is a, c, g, or t
cgggcagaggagccggggtggaactacgcatgagaacacggatatggatgaaaactttgaacccctgtccnaagaaagcaacgttggntgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450987 - DNA, 2599 bp, Homo sapiens
cataatataattaccgcaaccactgacctatacaccagacccccgcggctgctggggaccaggagacattacatgctcacctcatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450988 - DNA, 2433 bp, Homo sapiens
gaaatcacaacatggaattcctcgaataacaatttattgactcaagctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450989 - DNA, 1244 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggcatgtctgtctttggatggttatgtgggagggagcctatagggatgtagaagaaaaggatatgggcctattttccggttgatggacaggataaataagagagtgttcacctctagatgttttgctttctagccaaaaggacagagaatctgccatttataaaatgtttagaagtgggcatttctaatatgtgataagtaataaaggaatattgcaagttaaacttcatga

SEQ ID NO: 450990 - DNA, 1286 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggtaggtaatgccatatgtttgtcaaaggatattttcttagccttaccactgctccaatttggtggcctagaaagatgtatttcattgcagtgagtgcctaatggcatacttttcaaagtatcacactaaagtttcaggttatgtattttccattcttggaccaggtaagcctccaccctacccatgcccctgcttttaaaaaaaaaaaaatcatgattcacagccgggcgcagtggctcatgtctgtaatcccagcactttgggaggccaaggcaggtggatcacctgaggtcaggagttcgagatcagcctggccaatatggcaaaaccccgtctctactaaaaatacaaaaattagctgggcgtgctaatttacaggcgcacgtgtaattccagctactcgggaggctgaggcagaagaatcacttgagccccggaggcaaaggttgcagtgaatagagattgcaccactgcactccagcc

SEQ ID NO: 450991 - DNA, 1040 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggtaggtaatgccatatgtttgtcaaaggatattttcttagccttaccactgctccaatttggtggcctagaaagatgtatttcattgcagtgagtgcctaatggcatacttttcaaagtatcacactaaagtttcaggttatgtattttccattcttggaccaggtaagcctccacctcccccgggggaggtggaggtttatctttgggcattaattcttagggttcttcatcgctt

SEQ ID NO: 450992 - DNA, 1358 bp, Homo sapiens
cagatcagccaactcggggcggctgcactggtaggtgacagagataagggggcccaggaaagcaagaggtgcaaaggttagtggttcttagaccaagtccagaaaatggtacacccttgttaaggtgagaaagttatctttgcactaaaaagagggatgtagtgtatggccagaaactagcatgggggtccctggaaatactggccccaacttagccacaggtctcagggaaggtttttgtaactatcaagcaggtttctgtgcagactcagagagccctttcttatttctgccttttgaggaagtgaagcaggactagaagagccatcaggagccaacggggatgggaagcaaggagcctgcagtcagcattgtcactgggtagccccctctggcattactacctcagggtcggctagacatgcacagcagtttgggcaccagcattcaaataaaaaatcttggatgaaaaaccacaactagtaggcttagcttaagtgtgtttgtgaggtatgcacatgtgtatgtatgcaggtagaagatgggaagctctgaagcatgaaaccagttaggtcaacccatcacactgggttgcttatggccccagtctgagctccttgtatccttggacaaatgccttcctgtgttccctcttccttcatgtaacttgagccgagatgcctattctcacactgtaggaaggaatcacaccaacccaaacctaagtgcttcaggcttcgctgagtgagacgtttattcaaaacaaagattattgttttcatggttaggtgggattcaacaaggtttcatttatccctaattctgataagtcagtcttgagattttccccaaggttgctttttccctccttggtcacttataccctcagctaaaccaaaaaaaaaaaaaaaaaaaaaaattggcatcttgatgccagctcaggccttcaggtgtctttttaagtcactttaatttagcaccctgcccatagtaccatttcttcctcccagttgcgttctcctccatctcagtctccccgctttgcaatgccagattctctacaatttctcaccttgtacccagactgcaatatgtgatcctaatcctaattttttttattgttgacaggatgaaaactttgacctgtcaaaaagactgagtgagaacgaaattatatgtaatgctctgcagagacagaaagagagattggaaggagaaaatgatgtaagtgtgtgaaagagggtataaaaccccaaggttttaaggggaaggatcagggtggcccagagatgtagtgaaaaaaataaaaagttaagggccctttctgggacagtgggtgaaacagttgttcctaaacg

SEQ ID NO: 450993 - DNA, 3198 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaactta

SEQ ID NO: 450994 - DNA, 3661 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450995 - DNA, 2507 bp, Homo sapiens
  misc_feature (2362)..(2362): n is a, c, g, or t
  misc_feature (2379)..(2379): n is a, c, g, or t
  misc_feature (2384)..(2384): n is a, c, g, or t
  misc_feature (2389)..(2389): n is a, c, g, or t
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtaaacaaaaaaaaaaaaacaaaaaaaaaaaacaaccccgggggcctttnttggcgggggggggaanaaggnggttngaaggggccccgcggggcaaaagggtggtcccggccccagtttttttggcaaagggggaaaactcggcgggcccccaaagaggggcggcgaaaaatcgggaagaccggggaacccgtg

SEQ ID NO: 450996 - DNA, 3705 bp, Homo sapiens
taatctcagtatttgtcaggattttgcttttcctgacttgctttgcacagaatgttccctggatgaaagcccagaaatcaccaacatttcagacaatgctttctgagccttactctgttccacatttcataacaggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450997 - DNA, 3525 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatgtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450998 - DNA, 3924 bp, Homo sapiens
ggacggagtctcactctgtcacccaggctggagtgcagtggtgcaatctcggctcactgcaacctccgcctcctgggttcaagcaattctcctgcctcaacctcctgagtagctgggattacaggcgcacaccaccgtgccaacttattttttgtattttaatggagacgggttttcaccatgttgcccaggctggtctcaaactactgagctcaggcaatccacccaccttggcctcccaaagtgctaggattacaggcatgagccactgcacccggcctatattttcaatatatacaaataaaaagtgattttaagaagatgtagcccaattaggattttccccagtcccctttcaggtactaaataagaacttcttgtcattgcaggtggggtggaagacaacccgtgagtattacaccttcatgtgggttactttgcccattgacctaaacaacaaatcagctaaacagcaggaagtccaattcaaaggtgagaaaaatactggatcaaaggtgttgaagacagtagccaagactaattaattcccttcagcttgagctttctggggcagataaaaagatttccagaattttacttttctgaatagatcttattttggatgaaaaattatgttgtgttttcagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 450999 - DNA, 3458 bp, Homo sapiens
tggtgcggcgacatctagtaggatccccacccagcattacatcgcgtcgatcgaaggattggattggcatctttagacgtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 451000 - DNA, 2759 bp, Homo sapiens
tcgacccacgcgtcgcccacgcgtcgcggacgcgtgggtcgactcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 451001 - DNA, 2712 bp, Homo sapiens
  misc_feature (20)..(20): n is a, c, g, or t
cttaggctaggtacgaggcngggtgttgtgaaactactgcatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 451002 - DNA, 2429 bp, Homo sapiens
ggtccgtctcttcttctgaatcaagaaagtcttcccccagccctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggagcagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattaaacccagctgctcttaccaaggctttgaaggagaaatctggggttcc

SEQ ID NO: 451003 - DNA, 1243 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatgtaagtgtgtgaaagagggtataaaaccccaaggttttaaggggaaggatcagggtggcccagagatgtagtgaaaaaaataaaaagttaagggccctttctgggacagtgggtgaaacagttgttcctaaacg

SEQ ID NO: 451004 - DNA, 1156 bp, Homo sapiens
caggcgggtcgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacaggtagagtcatgagagaaaacaacacttttaggcatttgcaagaaaatatacgttgttctttgtataaagaacattttaatgttctttaatatacctggatgtcactggctttaggaaagggctcagaggaagctatctgaaatgagatagctcatggctttcttcagaaactgacgagagaagacttgcctctccctatgcatcctgcttgctcattagcttaacaggcc

SEQ ID NO: 451005 - DNA, 1631 bp, Homo sapiens
  misc_feature (1631)..(1631): n is a, c, g, or t
aggcaaggctgtacggtccggagtttttggagcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctctgtcccctctctgcgggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaagan

SEQ ID NO: 451006 - DNA, 2084 bp, Homo sapiens
  misc_feature (1717)..(1717): n is a, c, g, or t
gaaaaagcaggaaggcacggagtccctcgccttcgccctggctgcgctgtccccttcgcgcgcgggatgggtttgaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctctgtcccctctctgcgggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaaganaaaaaaaaaaaaaaaaaaaaaaaaaaaaaaaaaaaaaaaaaaaaaaaaaacaacaaaaaaacaaaaaaaaaaaggggccacacacaaaaaaccccccacaaggggacaaagcaaacagcacaacaagaagaaagagacaagaggggccccccaaaaaaaagacaaaaaaacaaaaggcaaagaatgcacggaagaaacacaccaccgagaaagaggaacaacagcgcaaacgggagaaaaaaggagagaaaaacaaacatcacaaagagcaagagaacacaaataaaagacaacaaaaaaccacacaacaagaaacaaaagacacacaaaaagagaaaacaaaaaagaaagaaaagcacgacacaaa

SEQ ID NO: 451007 - DNA, 1667 bp, Homo sapiens
  misc_feature (1667)..(1667): n is a, c, g, or t
gaaaaagcaggaaggcacggagtccctcgccttcgccctggctgcgctgtccccttcgcgcgcgggatgggtttgaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctctgtcccctctctgcgggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaagan

SEQ ID NO: 451008 - DNA, 1046 bp, Homo sapiens
gaaaaagcaggaaggcacggagtccctcgccttcgccctggctgcgctgtccccttcgcgcgcgggatgggtttgaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtgggtaaggtgcaacctagaccagtgttccttccatgggtggccccactgccacaaggagtcggcctggcaaacagaccttctaggatcgggatctccatctctcaagtcctgggttccatggctcatcccccaggtctccatggtctatttcccagggttccatggtccacctcccagggttccatggtccacttctca

SEQ ID NO: 451009 - DNA, 1717 bp, Homo sapiens
  misc_feature (1717)..(1717): n is a, c, g, or t
gaaaaagcaggaaggcacggagtccctcgccttcgccctggctgcgctgtccccttcgcgcgcgggatgggtttgaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctctgtcccctctctgcgggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaagan

SEQ ID NO: 451010 - DNA, 1630 bp, Homo sapiens
  misc_feature (25)..(25): n is a, c, g, or t
  misc_feature (1630)..(1630): n is a, c, g, or t
ccaggctggtacgccctcggtgtantggatgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctctgtcccctctctgcgggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaagan

SEQ ID NO: 451011 - DNA, 1819 bp, Homo sapiens
  misc_feature (1819)..(1819): n is a, c, g, or t
gaaaaagcaggaaggcacggagtccctcgccttcgccctggctgcgctgtccccttcgcgcgcgggatgggtttgaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgacctcgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggtgggtggcaggaccttgggggtgggaggggggtgggactggaggtacgggtctccctggtcccggcctgggcagctgagtggtgcctgccgggcggggcaggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctctgtcccctctctgcgggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaagan

SEQ ID NO: 451012 - DNA, 819 bp, Homo sapiens
  misc_feature (819)..(819): n is a, c, g, or t
gaacctaggaggcggaggttgcagtgagctgagatggcgccactgcactccagcctgggtgacagagagagactctctcaaaaaaagaaaaaaaataaaacaatcagaggtgggaaggagacagtcagggttgggggctcggcctctccccgtccctccacttccctcctcccctctcttcctgcagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctctgtcccctctctgcgggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaagan

SEQ ID NO: 451013 - DNA, 522 bp, Homo sapiens
acagacaagaaagcaaggccccgcgtcacatccatagctgcagcccaaggtcttgttcctgcaccttagacttgaacctttcttggttctctgtgatgtgttagtgtttatttagcccttgagaatttcctcaggtactatcacatttcctaatatcgtagtcaatatttagattcaaatggtataatgtgaatcattttcttaatttaaaataagagctaataagaatggctgaacatttactgaggatgttaaatatgcccactgttctgagctctttatgggaatgaattcatttcattctcaccgtagtcctatgcaggctgttattccattttacttatgagaatactgaggcatagtaaaaagcttattgaactagtagtaagtgccaaagattcaggtttaggcagcgtggcctcttgagtgtgtgctcttaatcactaggtcaaatcacctctctctgtttctgctgtaaataaatctactaccatttaaaatgaacattgtgtgcattaggaa

SEQ ID NO: 451014 - DNA, 837 bp, Homo sapiens
  misc_feature (2)..(2): n is a, c, g, or t
  misc_feature (7)..(7): n is a, c, g, or t
gncacgngatgcatgtcatggccgcctccatggcccggggaggcgtgagtgccaggttctgctgcaggctgccagggcacctggtggaacagacctgggggcacttccgggtcgggggagggggtggcgctggggacaaccagaaagtttcaagcgacaggctcgcgcccggcgggagaggaggacgcgggcggcccggagcggcccggggacgtggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacagg

SEQ ID NO: 451015 - DNA, 2572 bp, Homo sapiens
  misc_feature (2)..(2): n is a, c, g, or t
  misc_feature (7)..(7): n is a, c, g, or t
gncacgngatgcatgtcatggccgcctccatggcccggggaggcgtgagtgccaggttctgctgcaggctgccagggcacctggtggaacagacctgggggcacttccgggtcgggggagggggtggcgctggggacaaccagaaagtttcaagcgacaggctcgcgcccggcgggagaggaggacgcgggcggcccggagcggcccggggacgtggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaattagcgtggagtggtggtaagtgcctgtagtcccagctactcgggagactgaggtgggaggatcacttgagcccaggggatttaggctgcagtggagcggtgatcaggccattccactccagcctgggtgacagagtgaggccctgtctcaaaaaaaaaaaaaacaaaaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccagcaaagcttctggcgccgccctgtctgaacctggagcggctgggaggatccccctcccaggagaagccgaggaccccaggatgctgcagaatcagtgagaggtccctctggcctgcatgccaggagtcggtcaccgccctgtgcttcctccaagagacagtggagaggctgggtcagtcccctgcccaggacaccccggtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacagcctgccctgcagtagccgttctcaggaatcccctgcagatgctgttgggggccctgcagcccacccaggaggcaccgaggcccactcagcaggcagcgaggccctggagccccggcgctgtgcttcctgtcggacccagaggaccccgctctggagagacgctgaagatgggacccctctctgcaacgcctgtgggatcaggtacaagaaatacggcactcgctgctccagctgctggctggtgcccaggaaaaatgtccagcccaagaggctatgtggcagatgtggagtgtccctggaccccattcaggaaggttaaacccagcttcaccctgctgagctgctgcttctgcctccgtttcaccagtgggagaatgggcagaagcagctctcctaggaggattggggaaagagccggcctgcctcctctctgccatctccagattcaaggatcccgggggaagacccaggcctcaggtggcagagcctgctaggggtcaccagccccttctccagtcagccttggccgaggccccctcaggagacgctctcaggaaggatgagcattgttacagcagggacaataaagtacagagatatgccgagagaa

SEQ ID NO: 451016 - DNA, 2311 bp, Homo sapiens
tggctgctccacctgccatggaggcttcacaggccccttccaggtccaccccgtgtgcgctgggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaattagcgtggagtggtggtaagtgcctgtagtcccagctactcgggagactgaggtgggaggatcacttgagcccaggggatttaggctgcagtggagcggtgatcaggccattccactccagcctgggtgacagagtgaggccctgtctcaaaaaaaaaaaaaacaaaaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccagcaaagcttctggcgccgccctgtctgaacctggagcggctgggaggatccccctcccaggagaagccgaggaccccaggatgctgcagaatcagtgagaggtccctctggcctgcatgccaggagtcggtcaccgccctgtgcttcctccaagagacagtggagaggctgggtcagtcccctgcccaggacaccccggtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacagcctgccctgcagtagccgttctcaggaatcccctgcagatgctgttgggggccctgcagcccacccaggaggcaccgaggcccactcagcaggcagcgaggccctggagccccggcgctgtgcttcctgtcggacccagaggaccccgctctggagagacgctgaagatgggacccctctctgcaacgcctgtgggatcaggtacaagaaatacggcactcgctgctccagctgctggctggtgcccaggaaaaatgtccagcccaagaggctatgtggcagatgtggagtgtccctggaccccattcaggaaggttaaacccagcttcaccctgctgagctgctgcttctgcctccgtttcaccagtgggagaatgggcagaagcagctctcctaggaggattggggaaagagccggcctgcctcctctctgccatctccagattcaaggatcccgggggaagacccaggcctcaggtggcagagcctgctaggggtcaccagccccttctccagtcagccttggccgaggccccctcaggagacgctctcaggaaggatgagcattgttacagcagggacaataaagtacagagatatgccgagagaa

SEQ ID NO: 451017 - DNA, 2274 bp, Homo sapiens
tggctgctccacctgccatggaggcttcacaggccccttccaggtccaccccgtgtgcgctgggcctgtgaagcctccctggcctgctccacctgccatgtgtatgtgagtgaagaccacctggatctcctgcctcctcccgaggagaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaattagcgtggagtggtggtaagtgcctgtagtcccagctactcgggagactgaggtgggaggatcacttgagcccaggggatttaggctgcagtggagcggtgatcaggccattccactccagcctgggtgacagagtgaggccctgtctcaaaaaaaaaaaaaacaaaaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccagcaaagcttctggcgccgccctgtctgaacctggagcggctgggaggatccccctcccaggagaagccgaggaccccaggatgctgcagaatcagtgagaggtccctctggcctgcatgccaggagtcggtcaccgccctgtgcttcctccaagagacagtggagaggctgggtcagtcccctgcccaggacaccccggtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacagcctgccctgcagtagccgttctcaggaatcccctgcagatgctgttgggggccctgcagcccacccaggaggcaccgaggcccactcagcaggcagcgaggccctggagccccggcgctgtgcttcctgtcggacccagaggaccccgctctggagagacgctgaagatgggacccctctctgcaacgcctgtgggatcaggtacaagaaatacggcactcgctgctccagctgctggctggtgcccaggaaaaatgtccagcccaagaggctatgtggcagatgtggagtgtccctggaccccattcaggaaggttaaacccagcttcaccctgctgagctgctgcttctgcctccgtttcaccagtgggagaatgggcagaagcagctctcctaggaggattggggaaagagccggcctgcctcctctctgccatctccagattcaaggatcccgggggaagacccaggcctcaggtggcagagcctgctaggggtcaccagccccttctccagtcagccttggccgaggccccctcaggagacgctctcaggaaggatgagcattgttacagcagggacaataaagtacagagatatgccgagagaa

SEQ ID NO: 451018 - DNA, 539 bp, Homo sapiens
tggctgctccacctgccatggaggcttcacaggccccttccaggtccaccccgtgtgcgctgggcctgtgaagcctccctggcctgctccacctgccatgtgtatgtgagtgaagaccacctggatctcctgcctcctcccgaggagaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacagg

SEQ ID NO: 451019 - DNA, 776 bp, Homo sapiens
gtgggtttcatcgggtgggcccagcgggacagggccgggtgaaattagggagggggctgggctggggcgcaatggaggccgagccaatcccggactcctcaatgccagcaaagcttctggcgccgccctgtctgaacctggagcggctgggaggatccccctcccaggagaagccgaggaccccaggatgctgcagaatcagtgagaggtgcgtaaggccaaaccccattccccggaccccgctagcacttcaccacctggctcagtgatcaaggggtcatgacctctctttgctggggttatcgagaagtggcaattttataatagttactgaaacttacaaagaggttctggtgcccagagacacttggggtcatctagggatcagaggccatgcaattccatgtctctggggctgatgtaggcactccccagggatcatccaggggttatggagggcaactcaataataatgaaaatgataaaaatcgtaatcatattatggcaagccagcggcgtggtggcgcgtgcctgtaagtcccagctactcgggaggctgaggcggaaggatcggtcgagcccaggagttctaggctgcactgagtcctgatcacgcccctgcactccaggcgggggtacagagtgaggctcggtctctaaaagaaacacaaagaaaaaaagtaacctttttctcgatcctgcagccagaggcttgatatcctgcctcggtcacctagggcggtccctgcctgggtgatctacgggtgccgtaaggg

SEQ ID NO: 451020 - DNA, 774 bp, Homo sapiens
gctcggcgcagccgctcaccgaaccgtgttttccaggctcgcgcccggcgggagaggaggacgcgggcggcccggagcggcccggggacgtattctacccgggccctgagcccatcatccagttcggcattcgcacttccatctgtccccagggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacagg

SEQ ID NO: 451021 - DNA, 703 bp, Homo sapiens
cggagcggccctggggacgtattctacccgggccctgagcccatcatccagttcggcattcgcacttccatctgtccccagggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacagg

SEQ ID NO: 451022 - DNA, 2663 bp, Homo sapiens
  misc_feature (2)..(2): n is a, c, g, or t
  misc_feature (7)..(7): n is a, c, g, or t
gncacgngatgcatgtcatggccgcctccatggcccggggaggcgtgagtgccaggttctgctgcaggctgccagggcacctggtggaacagacctgggggcacttccgggtcgggggagggggtggcgctggggacaaccagaaagtttcaagcgacaggctcgcgcccggcgggagaggaggacgcgggcggcccggagcggcccggggacgtgtgagtgcagggggccaagtcccccattcctcatcccacggaattcctctggtccccatcttgccctgtagcttcatctcgaggtcccccttctgctttgccctattcagtacctgtgcgtcaagcctcaattcctacttcctaaccctagattctacccgggccctgagcccatcatccagttcggcattcgcacttccatctgtccccagggtgaacgtggtgttcgtagaccgctcaggccagcggatcccagtgagtggcagagtcggggacaatgttcttcacctggcccagcgccacggggtggacctggaaggggcctgtgaagcctccctggcctgctccacctgccatgtgtatgtgagtgaagaccacctggatctcctgcctcctcccgaggagagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaacccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaattagcgtggagtggtggtaagtgcctgtagtcccagctactcgggagactgaggtgggaggatcacttgagcccaggggatttaggctgcagtggagcggtgatcaggccattccactccagcctgggtgacagagtgaggccctgtctcaaaaaaaaaaaaaacaaaaacaaaaacaaaccacacctgcatctgctgtgctgggcccccggttctcttttccctctgggatctaagatgccgctggggatccaaggcagaggcctgggagcccccatttccgagggggagggctagcgtggaaggccccgccccggcagctgcggagggatttggtggggtccaggccgcccttgccacgcaggggtgcgcggatgacctgaaaaaagccagaaagaggaaaggtgccgccgaggctggtcgctctcagctggggctcatcgcatcctctaccaagagcgctcccaccacacaggtcccgcccctcccagcaaagcttctggcgccgccctgtctgaacctggagcggctgggaggatccccctcccaggagaagccgaggaccccaggatgctgcagaatcagtgagaggtccctctggcctgcatgccaggagtcggtcaccgccctgtgcttcctccaagagacagtggagaggctgggtcagtcccctgcccaggacaccccggtcctggggccttgctgggacccgatggctctggggactcagggccgcctgctgctggacagggattccaaggacacacagaccaggatcagccaaaagggccgccgtctgcagcccccggggactccctcggccccaccccagagaaggccccggaaacagctgaacccctgccggggcaccgagagagtggaccctgggttcgagggggtgactctgaagtttcagataaagccggactccagcctgcagatcatccccacgtacagcctgccctgcagtagccgttctcaggaatcccctgcagatgctgttgggggccctgcagcccacccaggaggcaccgaggcccactcagcaggcagcgaggccctggagccccggcgctgtgcttcctgtcggacccagaggaccccgctctggagagacgctgaagatgggacccctctctgcaacgcctgtgggatcaggtacaagaaatacggcactcgctgctccagctgctggctggtgcccaggaaaaatgtccagcccaagaggctatgtggcagatgtggagtgtccctggaccccattcaggaaggttaaacccagcttcaccctgctgagctgctgcttctgcctccgtttcaccagtgggagaatgggcagaagcagctctcctaggaggattggggaaagagccggcctgcctcctctctgccatctccagattcaaggatcccgggggaagacccaggcctcaggtggcagagcctgctaggggtcaccagccccttctccagtcagccttggccgaggccccctcaggagacgctctcaggaaggatgagcattgttacagcagggacaataaagtacagagatatgccgagagaa

SEQ ID NO: 451023 - DNA, 421 bp, Homo sapiens
tgttcgtggacccaagggaggaactccatacagaggcactcgaagagtttacggggcctatttctacccaaaagtcgtacatcgcacgacttcgtcttttatacatttaaagtgcagaggtttttatttttttctgcttagcctcaaggttgaggttttccatgatttgtaatattacagacaagacgatcaaaaccatggcttttcacttgaatgtatattgttaagtcccattccttttagattaatgaaaagaatgaataaacatttgaaggaaaaatatgagtactataaggattttgacttaatttttatgtaccttgccattcaattttattatatgtatatatttgtaataaatgagggtgaggtgttgattgttcaataagtttcatgagcataataaagtctattttaattc

SEQ ID NO: 451024 - DNA, 3352 bp, Homo sapiens
gagcggccgcccgggcaggtaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtta

SEQ ID NO: 451025 - DNA, 3108 bp, Homo sapiens
gagcggccgcccgggcaggtaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttaaaaaaaaaaagtcgacgcggccgcgaatttagtagtagta

SEQ ID NO: 451026 - DNA, 4030 bp, Homo sapiens
gggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtta

SEQ ID NO: 451027 - DNA, 2067 bp, Homo sapiens
attgggaaagggcaggcacacagggacagaagttcttctgggttctgggtttcatccaggaccagcagtacggtctttcagccctcaggctgttttaagcctgaaggtaagagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtta

SEQ ID NO: 451028 - DNA, 4248 bp, Homo sapiens
gggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtaagagactggatggccttcacaagcgttagttaagtcagaagcagtgacaatctggtcagtttttgtcataccagagagcattccgcaaagctgcttgttttccaatttcttcattcttccccttagcactggtgcagctgaatttgatcctttgtgtattcctgtcactattcagatcttttctctctctttctctcttactctctttttttccagaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttaaaaaaaaaaagtcgacgcggccgcgaatttagtagtagta

SEQ ID NO: 451029 - DNA, 828 bp, Homo sapiens
ggaatgagaaagaggaaaactctgagaaagcagccacacagaagccaagcgaagggaggatttccaaggtcagcagatggagcaaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttaaaaaaaaaaagtcgacgcggccgcgaatttagtagtagta

SEQ ID NO: 451030 - DNA, 3826 bp, Homo sapiens
gggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattggtaaggacctgaaagcctgtggtgggaacagccagcattattgaagtttcggctttaggaagatatcacatggctatcaggttttctaagggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtggagttttcctgcacaagctctctttgcttgctgccatccatgtaagatgtgacttgctcctccttgccttccaccatgattgtgaggctaccccagccacatggaactgttgacatggattttattcaacagacaagctgacatttatcaagatgctttcaattacaccaaaagaaatagaagtcttcgtcttattgctgtttatgtggcagtattgttctcctacaataagttgatggaaatgagttgttttgtttttcattttagccattttacaagtaagtttgctattgttgttgctgtttttagaataaaatgattttaccaataacatt

SEQ ID NO: 451031 - DNA, 3249 bp, Homo sapiens
gggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttaaaaaaaaaaagtcgacgcggccgcgaatttagtagtagta

SEQ ID NO: 451032 - DNA, 513 bp, Homo sapiens
ccctgggttgtcctgtcttcactcctgtgcctccttcctggtcttcagccagccagcagccccgctccatctcttggtccattgtacctccaaagtgttgttcacatgcttattacggaaatgccaagtagtagctggaaggaggattaaaaacagtacttaaaatgctcttagagcaggatttgctttgtagttaggtccccaaaagtggtagctattataataattaagcttttttcccggccttagtggaccttaacattgggaatacttctgtaaatacaaatcgtgtttgaaacatttgaattgagtctttgaagtaaaactttagaaatagatatatagttattttcttaatggtgtgttgatgctgaattgagtaaaaatgtagttggtcaagactaactctactgaaatttaaaattatgtctcattttctcttccttattgtagtgatttaaagggagtgatagtcactctgagtgatgatggtcacttgcagtgttcatacct

SEQ ID NO: 451033 - DNA, 4153 bp, Homo sapiens
gggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtta

SEQ ID NO: 451034 - DNA, 4273 bp, Homo sapiens
gggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtta

SEQ ID NO: 451035 - DNA, 4119 bp, Homo sapiens
gggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattggtaaggacctgaaagcctgtggtgggaacagccagcattattgaagtttcggctttaggaagatatcacatggctatcaggttttctaagggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttaaaaaaaaaaagtcgacgcggccgcgaatttagtagtagta

SEQ ID NO: 451036 - DNA, 1398 bp, Homo sapiens
aacgattaaagtcctacgtgatctgagttcagaccggagtaatccaggtcggtttctatctacttcaaattcctccctgcaaaaggacaagagaaataaggcctacttcacaaagcgcccttcccccgtaaatgatatcatcttaacaaaccctgttcttgggtgggtgtgggattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcatagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttaaaaaaaaaaagtcgacgcggccgcgaatttagtagtagta

SEQ ID NO: 451037 - DNA, 3293 bp, Homo sapiens
gggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaggcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcagacacaatggtggaagggcatttaaaggaacttgaagaggatgcttgatttaatgctttccagattttctatatagtaagacttcgtcttttatacatttaaagtgcagaggtttttatttttttctgcttagcctcaaggttgaggttttccatgatttgtaatattacagacaagacgatcaaaaccatggcttttcacttgaatgtatattgttaagtcccattccttttagattaatgaaaagaatgaataaacatttgaaggaaaaatatgagtactataaggattttgacttaatttttatgtaccttgccattcaattttattatatgtatatatttgtaataaatgagggtgaggtgttgattgttcaataagtttcatgagcataataaagtctattttaattc

SEQ ID NO: 451038 - DNA, 1119 bp, Homo sapiens
  misc_feature (10)..(10): n is a, c, g, or t
  misc_feature (12)..(12): n is a, c, g, or t
  misc_feature (38)..(38): n is a, c, g, or t
  misc_feature (49)..(49): n is a, c, g, or t
  misc_feature (56)..(56): n is a, c, g, or t
  misc_feature (69)..(69): n is a, c, g, or t
  misc_feature (75)..(75): n is a, c, g, or t
cgcagagggnangtagggagagagtttggtttggaaangaactccgttnatatccnacctcggggaggnagcagncggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacatttt

SEQ ID NO: 451039 - DNA, 862 bp, Homo sapiens
  misc_feature (38)..(38): n is a, c, g, or t
  misc_feature (794)..(794): n is a, c, g, or t
gggtgttgcgaatagttattgtgctaaatttttggctnacagcgttgtggcctagggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgttccgtggctctatgggccactacaaaaattatttgggttttagtcggttctagggcccacagaacatattaggtggttaagccctacatgtcccactggttttgatcagtgtcacacgtacttcttatgatcttgccctaacatttctgcttagcggaatggaattgattggcttattacaaaagagctatgaataaatggatggatgtnaaatctggtttgtcggggtcctgttgagtacatttggagaagacgggtaagtatttatgaatattaat

SEQ ID NO: 451040 - DNA, 930 bp, Homo sapiens
agtatccatctccccctcccgcattgcgagcccactggcaaccgacccgcgactcgccaccgtatccccggcgcaacttataaaacttcccggtggtcattagccaaccagggcccgctaaggctttaggcaaaattttatgtccccaaccgccccaagacgcgccacaggcacctacgttatcacgcctgccccatctccagaggaacgaactcccatgcgggggttgttgcctccatcccgcgagctatgtcagttcccgaccctctaactggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaacctcgatgcggtcagccccccatctatcttccccattcttcatttacgcgtgt

SEQ ID NO: 451041 - DNA, 4484 bp, Homo sapiens
gtgtgaatatctacaggaactctttattgtctataaatagactttattttaaacagaaaaccagtaattaaaaattatttctgcttgtgttggttgtcattgggaagtattttgtttaaatgagataaaatattaaaagtatacagtttggtctctttcttcccacccaggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggtgcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacatttt

SEQ ID NO: 451042 - DNA, 1447 bp, Homo sapiens
cacacaaacacacacacaccctctacctcacagaaccttggaaagagtgaaacactgtctggaaagcattttgagttctgcagaaaagactgccttaaacatctaaagttatgttcctagttatcttcatatttcttctctcccacacaagtacttaaattttagtagcaaaagcagttagttgtccctgatcatcactgagtgggctgagtattttgttttgttgtgagattgtctcaaattttggctttatcacaggactcagaagctgctatcgaaaaacccaaagaatccttatgaggagtcgagcagagatgtgaggagtcgcaggcctgctgacactgaggatgggatgtcctcttgccctcaaccttggggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacatttt

SEQ ID NO: 451043 - DNA, 4042 bp, Homo sapiens
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacatttt

SEQ ID NO: 451044 - DNA, 4644 bp, Homo sapiens
  misc_feature (4370)..(4370): n is a, c, g, or t
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggtgcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttcacaccactacaacccgacggtcgctcttgctcgcccctacaccctccgcacaatcgacgggctacagacacacagttccactggcgtgggacgcccacccaancaattctctttgctcccgcacctaacctctatatatacggcactgctagggactccaatcgcccgcccgccgtccagaacccggggacgcccctcacccgcctcttcccccacgtcacctcttgccgcccgcgctcaccggcctcgtgaggaccatccgccggcgccgtgcctctcgtccctgccgccggacctccttgctctctcgatctcacgccagccaaccgacttcgctgtcctagttcccccgcgccgagactgcactgcccgtccgc

SEQ ID NO: 451045 - DNA, 4527 bp, Homo sapiens
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggtgcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttccaaccactcctactgtactgttatccgcacgctccagttctgcgacaaccactcacgtacctatcacaaacccacatccggacaacagtcctttgctatttgtgctgtttttcttacatcttctaccccactttcgtccccgccgcttccgccctcccttattaacctcatgcccaccagtccaccattccactgagtcggctcccccctatatatccctctttgtttttggctccactattcatccgccgtttcccctctcgattgtctcatttatgtctccgtcgcccatctccattccccccttcacaatctttcgttcgcgcccctgtctctccttattccccccccctttcctgatccctct

SEQ ID NO: 451046 - DNA, 3993 bp, Homo sapiens
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggtgcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggggtcaatgcaaccaacttcatggaggcaggagccccagttatgtggaatgggcacagagcaaggctgctggattccagtatccagtgataagggctcctgtccccagaattttccctcttggtgtgattgcacagaatttgtatgtattttcagttacaagattgtaagtaaattgcctgatttgttttcattatagacaacgatgaatttcttctaattatttaaataaaatcaccaaaaacataaacatttt

SEQ ID NO: 451047 - DNA, 2784 bp, Homo sapiens
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggaagaagctaaccaactaataatctgtataagatacctattttgcccattctctttggcttaagataagtataatttaaaattttatgtatttataagattctctaaaaattaaagatatacttcacaataagtgatatgcttatgcacaaccttagactttatcatccttttacttcaggggtatttattgacacattacaggaactgaagatacagtggagggtaaaacaaatatgatatctgcaaagccaaggaatctagtgcagaacacatacattact

SEQ ID NO: 451048 - DNA, 422 bp, Homo sapiens
tttttttttttaccccagaagcttaggtcataagttttagtcaaatgaatagattaatggatgggttcctattttatattaatagcctcaaaattataatttaacgattgctggaaagatctcagtccttatggtctgaaactctggcagaaagtgatttatttacatatttgcctaatcggataggtgggaactctgtaaagactaattcagcagtaacttgtgaactttatgtccaagatgcagggcgtgcctgatgttggcaacagcacctgtaaaggactgaataagaattgaatatacgattatgcttattctttccaactagtcccatttatatcaggattgcctaaatattgcactagttcataattttgcccacagatatagatgaatgtgagatgggtgtcccagtgtgcccc

SEQ ID NO: 451049 - DNA, 449 bp, Homo sapiens
ctgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggtgaccctgtctttcctttggtactggaaacctctttctaagacctcccaggggaatgcctgtctccttgagatgagatgtatgaaatagtacctctacatactacatttaaaacgtgaaataggctgggtgcagtgacccatgcctgcaatcccagcactttgggaggccgaggcaggcagatcacttgaggtcagaagttcgagaccagcctggccaacatggtgaaaccccgtctccactaaaaaggcaaaaagtaacaggcgtagtgatgcacacca

SEQ ID NO: 451050 - DNA, 4889 bp, Homo sapiens
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggtgcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacatttt

SEQ ID NO: 451051 - DNA, 1104 bp, Homo sapiens
  misc_feature (60)..(60): n is a, c, g, or t
gcagggggtgttaggggaaagttagtttggaaggcctcgaggtcaaccacctttgctggnaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacatttt

SEQ ID NO: 451052 - DNA, 4810 bp, Homo sapiens
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggtgcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacatttt

SEQ ID NO: 451053 - DNA, 4726 bp, Homo sapiens
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggtgcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaagcaaaccgccccctggctccggcaatgacaaagtcgtaagtttgatctcgaccatccatcgattcgactccatgaaacgcgggcctattacataccgataaaaaacagaggatgaatacgccccctcatagtagcgcgccccgctagtaattgcataaccgaccccgcctgcccccatcgacgacggcttcagcatctgccacttaacacttactggccatctgtccagataccctgcgcagactttctttcttgaaacaagctccgtggccttgatccatcgttagcttgcgtgccctttcaccaaat

SEQ ID NO: 451054 - DNA, 4529 bp, Homo sapiens
  misc_feature (4295)..(4295): n is a, c, g, or t
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggtgcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagagaccgcccctgtgcccccgtcccatctttaagcagactcacttgaaatttatttccacccaacattcctgggaacacccattaggccaacttttttatcacgcccaaatggtgaccatcccactcttggaattggggccccttacccactccctcccacattnaatgtgtttcgttgcttgtgtttctgtgccatgataatctcagtgttttcggtgtaagtttcttatcattgtatagatacactcttattaggtcccctgggcccaaccctccttgtccccttcttcattactgcaaatctcactatatcctacgcctgtggtgcgtcttctctccctagtggtcttacgtccccacgtgttctgatcatgatgtattggatcagagaggagtgt

SEQ ID NO: 451055 - DNA, 3123 bp, Homo sapiens
agagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaataagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggcgtcagacttgcatacgcagccgatcagcatccttcgctgcccct

SEQ ID NO: 451056 - DNA, 4061 bp, Homo sapiens
gaggagagatagaaggaaaaatacctctttaaacaaaaaatctaaagcagcaactaaggtttctgactatcatccctagcaaactttccagatttctttttaaaatctcattccaagtttctttcctcagctctatcctcaccacttccctgtaattttatctccccttgccatcttcatcttaaatgaataacagattttaacatcaatgtaactagaacagctttttgaaatttccaactgaaaattattctattatttatacttgcatttgaattccatctctgccacatagctctggccttgggcagttcgtctaccttctctaagctatactttccccatcagcaaagtgtagctatacctaatttgcatagcatccgcaggaatttgcagctagagataattttcataaagtgtttagtataattttcatgaagtgcctgacacgcagtgttctcgaaaagagagcttttattgttaaggtgattatagttggtgaataaactatctatttgctaaggtaccatctccagggagagcaaggttggagcctaaggggaaagatgggacgcaggacaccagctaatcttttcctctgtacaattaatgacagctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaatttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaattttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaa

SEQ ID NO: 451057 - DNA, 3623 bp, Homo sapiens
tgctgtaggaagtcaagcaagttctttaggttctctgctgtttaaaaagtatccctgtgtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaatttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaattttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaaaaaaaaaaagggggggttaaaattcctgaaggggcagttacgtaccgtttttgtaaggggccaaaggggtaagagagggggttaaggtgggaacggtggttggagaaccttgggggatggacccaaacgaaaaagtgttgattggatggtaaaaacgg

SEQ ID NO: 451058 - DNA, 3484 bp, Homo sapiens
tggtgatctagaggatcctctggagctggttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaatttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaattttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaaaaaaaaaaagggggggttaaaattcctgaaggggcagttacgtaccgtttttgtaaggggccaaaggggtaagagagggggttaaggtgggaacggtggttggagaaccttgggggatggacccaaacgaaaaagtgttgattggatggtaaaaacgg

SEQ ID NO: 451059 - DNA, 3058 bp, Homo sapiens
  misc_feature (13)..(13): n is a, c, g, or t
cgctgactaaggnctggcacttcttggccagcaccacccccagcatgtccactgggctgctgaacttggtcttccacttctcaaagtccttcttgaggctctccctgatctcaaaggtggagaaagtagatcttgcatcaggttgaactccagtttctttttgctcagtttttcaagcgctgagtttattttgtccctaggcataaagaaatctttctaggaacccctttggttatgggaccagatttttaaaagctttttaggcttggtgaaaaatctgccttatcactagcaacactacgacttgtctctgttcttgttttttgttgtactcgtgtaaaagaaaagttcaagggaagagaacaggctcaagtctacttctcacgctggctctggggattaggaaattcagaaagttttgtttcagactggcagtgctgtctgatataaacacagcgtcaagtactgcacgctgtagctacctgaggtttaggccggaagaggcacggctgatttaaaagtgaaagaaagtaaccaattggttcgcagacaaccttttcccaaaaggcgggcgattcaaacccctagccccacctgctccgtttcccgcccagctggagctctggagcctttgcttcctcaaatacgagcgggaactgcgttgagcgctggattccaggccgagtgctggcgaggcgcgcagttctctgctgtttaaaaagtatccctgtgctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatatcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaa

SEQ ID NO: 451060 - DNA, 1088 bp, Homo sapiens
  misc_feature (13)..(13): n is a, c, g, or t
cgctgactaaggnctggcacttcttggccagcaccacccccagcatgtccactgggctgctgaacttggtcttccacttctcaaagtccttcttgaggctctccctgatctcaaaggtggagaaagtagatcttgcatcaggttgaactccagtttctttttgctcagtttttcaagcgctgagtttattttgtccctaggcataaagaaatctttctaggaacccctttggttatgggaccagatttttaaaagctttttaggcttggtgaaaaatctgccttatcactagcaacactacgacttgtctctgttcttgttttttgttgtactcgtgtaaaagaaaagttcaagggaagagaacaggctcaagtctacttctcacgctggctctggggattaggaaattcagaaagttttgtttcagactggcagtgctgtctgatataaacacagcgtcaagtactgcacgctgtagctacctgaggtttaggccggaagaggcacggctgatttaaaagtgaaagaaagtaaccaattggttcgcagacaaccttttcccaaaaggcgggcgattcaaacccctagccccacctgctccgtttcccgcccagctggagctctggagcctttgcttcctcaaatacgagcgggaactgcgttgagcgctggattccaggccgagtgctggcgaggcgcgcagtgagtgagcacacagggcgctggggtgctccgcggggcgcggtcacgggcgcggccgcggcgggctcgagtcccggctgggaggagaaggagctgggtgtcaggaagccggggactgacagcgccacccatctggggagccgggaggacacaggttttattttggtagtgctgcaagtccccttgtgtgctggggggagcggggcggcgtggtaggattggaagaggcttagagttggcctcgacccctgcccttgcccctggaaaggcagaaagtgggggttggggtgcggagaagcaggaagagagggagagtgaaggaggggaggaaagggagagaggaagagggagagtgaaggaggggaggaaagggagagaggcagaga

SEQ ID NO: 451061 - DNA, 4335 bp, Homo sapiens
  misc_feature (13)..(13): n is a, c, g, or t
cgctgactaaggnctggcacttcttggccagcaccacccccagcatgtccactgggctgctgaacttggtcttccacttctcaaagtccttcttgaggctctccctgatctcaaaggtggagaaagtagatcttgcatcaggttgaactccagtttctttttgctcagtttttcaagcgctgagtttattttgtccctaggcataaagaaatctttctaggaacccctttggttatgggaccagatttttaaaagctttttaggcttggtgaaaaatctgccttatcactagcaacactacgacttgtctctgttcttgttttttgttgtactcgtgtaaaagaaaagttcaagggaagagaacaggctcaagtctacttctcacgctggctctggggattaggaaattcagaaagttttgtttcagactggcagtgctgtctgatataaacacagcgtcaagtactgcacgctgtagctacctgaggtttaggccggaagaggcacggctgatttaaaagtgaaagaaagtaaccaattggttcgcagacaaccttttcccaaaaggcgggcgattcaaacccctagccccacctgctccgtttcccgcccagctggagctctggagcctttgcttcctcaaatacgagcgggaactgcgttgagcgctggattccaggccgagtgctggcgaggcgcgcagttctctgctgtttaaaaagtatccctgtgctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaatttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaattttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaaaaaaaaaaagggggggttaaaattcctgaaggggcagttacgtaccgtttttgtaaggggccaaaggggtaagagagggggttaaggtgggaacggtggttggagaaccttgggggatggacccaaacgaaaaagtgttgattggatggtaaaaacgg

SEQ ID NO: 451062 - DNA, 3663 bp, Homo sapiens
aatagaagcaggcaaggaccgccgtgggcacggggtgtccccagcgcagccaatcggtttccgaagtcgggtctctgctgtttaaaaagtatccctgtgtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaatttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaattttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaaaaaaaaaaagggggggttaaaattcctgaaggggcagttacgtaccgtttttgtaaggggccaaaggggtaagagagggggttaaggtgggaacggtggttggagaaccttgggggatggacccaaacgaaaaagtgttgattggatggtaaaaacgg

SEQ ID NO: 451063 - DNA, 1942 bp, Homo sapiens
tgcagggagactatagaatatccctcttgggggctttggttacagtgagagagcggagaagtgtacggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaatttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaattttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacatcatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgagaaa

SEQ ID NO: 451064 - DNA, 6646 bp, Homo sapiens
cgtgtacttccttgtttgtctttgtcgctggccgacttgtcttcattccaggtggccagagcgagtggggccgggcgttgtcacgggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctacagagtgtccggcagtggtaccagcagcagctcgccctggcacaggaggcccgcgtcaggctgcagggtgagatggcccacatccaggttggacagatgacccaggctggtatcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451065 - DNA, 555 bp, Homo sapiens
cttacattatggacgtggacaccagaggggctgtgggccttatcctggccaccccgcctgtgggacggggcccatgggctgctcctctcagagtgaagcctttgtgggatgagaaagtgccgtgctcatgagtctggatcctcttctctcctactccagctgcatgtctgaaaagcgacgtcaccttgttgttaaagccatggtggtccagcgtgctctgtctttccaggtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgtaagcatccgttaccccgcttttcccaccctccacgtccgcgtcgctcagcc

SEQ ID NO: 451066 - DNA, 4070 bp, Homo sapiens
gagcaaggaagattcaggacaggggactccgcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451067 - DNA, 2552 bp, Homo sapiens
tggggtttcaccatgttggccaggatggtctcgatctcctgacctcaagtgatctgcccatctcagcctcccaaagtgctgggattacaggcgtgagcccctgcgcccggcctgtcacccagtctttaagaagcatatgctcatgttattgaagaagaacctacttattattgattgccttttgaaaatttgttgggaataatttacctgcaggatttagggatagtcagaaaattctaagaaatataattattttatttaccttctaaagccaaatattcttacacagaaaggtcctctgttgttctggttttactttgttgctgaggatctttccttcctgctggtctcttcctctcaggccactggccctgtgtgattccaccgtggctggccactgggaaggggcagcttggacccttggtcaggcctgacggccatcaggaggcacaaggacactgaggccccatatctgatctgacctttgggggggcacagggagaggccggtggaggaggaggaggagagcagaccaggggctccctgcagcgactcccgcggtttcccctggagtcaggccaggtgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451068 - DNA, 6699 bp, Homo sapiens
cacgtctccgccggagcatccgggccgggcggcctccggggctgccagagcagcaggagactgggtgtgttgctgtattgcccaggctggtgtggaactcctggcctcaagcgatcctcccaccccagcctcccaaagtgctggtgttacaggcagtataccttaaatggcaagaaggaaataaatcatctgacatcactcagattgaagaggagctttttttcccccgattgccttaagaagtagcatactttcccaagtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctacagagtgtccggcagtggtaccagcagcagctcgccctggcacaggaggcccgcgtcaggctgcagggtgagatggcccacatccaggttggacagatgacccaggctggtatcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451069 - DNA, 6322 bp, Homo sapiens
gtccaaggggaccggaccacccagcttgagctgacgctgaggggctaacgagtgaaccttggacaagcttggcttctgccatcagcaacagccaagagctcctggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctacagagtgtccggcagtggtaccagcagcagctcgccctggcacaggaggcccgcgtcaggctgcagggtgagatggcccacatccaggttggacagatgacccaggctggtatcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451070 - DNA, 1999 bp, Homo sapiens
  misc_feature (16)..(16): n is a, c, g, or t
  misc_feature (38)..(38): n is a, c, g, or t
gcgacttctccttgcntatgggaagtcctcaagtgagngatgttcaccatgtatttttttttctcttaggacagactaattctgaaaataccgaagaaaagtagctctatgttctcaccccggttttcctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451071 - DNA, 2823 bp, Homo sapiens
aactcaggggcgagctgcaactaactcagtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451072 - DNA, 2809 bp, Homo sapiens
cctttcctggagccctcagtgtaacatctgtgaggatgtgtcccctcctggagctctctgtaacatttgtgcagatgtgttcccctcctggaggcttcagtgtaacatctgtgcagacagattcccctctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451073 - DNA, 1744 bp, Homo sapiens
tccgtctcaaaaataaataaatgattttaaaaaatctaaaatcgagaaatcacacattcagtggggagcgacttcttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttggagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451074 - DNA, 980 bp, Homo sapiens
cttacattatggacgtggacaccagaggggctgtgggccttatcctggccaccccgcctgtgggacggggcccatgggctgctcctctcagagtgaagcctttgtgggatgagaaagtgccgtgctcatgagtctggatcctcttctctcctactccagctgcatgtctgaaaagcgacgtcaccttgttgttaaagccatggtggtccagcgtgctctgtctttccaggtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagagggtgagtctccctctcccgaacaagctcatggaaagcttcctgtgccagagacaactgttggtcccacataacccggggacctgccattggcttctctgagctgccatgggctcaggggcaacaagcacattttatttctaaatctgccaattgaaaagcaaagaaagcaaacacgggtgacctcagaggtactgtgggttcagttctggaccaccacaaaaatgtaaacattgcaataaagcaagtcctacaatgtttttggtttcctagtgcataaagaagttatgtgtatacgctactgtagtttactaagtgtgcagtagcactgtgtctaaataaaactgatgtacccacattaaaatgaa

SEQ ID NO: 451075 - DNA, 4032 bp, Homo sapiens
cacgtctccgccggagcatccgggccgggcggcctccggggctgccagagcagcaggagactgggtgtgttgctgtattgcccaggctggtgtggaactcctggcctcaagcgatcctcccaccccagcctcccaaagtgctggtgttacaggcagtataccttaaatggcaagaaggaaataaatcatctgacatcactcagattgaagaggagctttttttcccccgattgccttaagaagtagcatactttcccaagtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctacagagtgtccggcagtggtaccagcagcagctcgccctggcacaggaggcccgcgtcaggctgcagggtgagatggcccacatccaggttggacagatgacccaggctggtatcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaagagccacgcgacgagccgcaccaagagccacacaaggggacccgaggtgccccaccatgagccacgcaaagagccacccaacgagcggcgcctggtggtagctggttgtccaagatagaatcttagttcaactttaaatttgcccaaagagccacacgaagagccccgcgaagagccacgccatgagccacgcgaagagccacccaacgcgccccgaatgag

SEQ ID NO: 451076 - DNA, 709 bp, Homo sapiens
cacgtctccgccggagcatccgggccgggcggcctccggggctgccagagcagcaggagactgggtgtgttgctgtattgcccaggctggtgtggaactcctggcctcaagcgatcctcccaccccagcctcccaaagtgctggtgttacaggcagtataccttaaatggcaagaaggaaataaatcatctgacatcactcagattgaagaggagctttttttcccccgattgccttaagaagtagcatactttcccaagtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtaagtcgtgaggttcctctgtgtgctggtcacaggaggacctggtgttgagggaggacgtggtgttgagggaggatgtggcgttgagaccactgtgagcttttcacttaattcaaagttgttttttttttttt

SEQ ID NO: 451077 - DNA, 475 bp, Homo sapiens
gacctggactggcatcatctagatggcgccgaggaggacatgtgtgtgcttaacctatgaaaatacaaactcggatcttggcaggatgtttaagatctgttagcttttaaaaatctgacttcattttccacagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacggtactcaggcccgcgtccctcccggggtagccgacgtgcgctgtagatgctctcggacaggaggctggcagacgtgttagtcattcagacataaacggatttgttgagcccacactgagcagctgctgtgtagtcagtggtaatggggtgacagatgaaatcatttcattctggttt

SEQ ID NO: 451078 - DNA, 635 bp, Homo sapiens
  misc_feature (16)..(16): n is a, c, g, or t
  misc_feature (38)..(38): n is a, c, g, or t
gcgacttctccttgcntatgggaagtcctcaagtgagngatgttcaccatgtatttttttttctcttaggacagactaattctgaaaataccgaagaaaagtagctctatgttctcaccccggttttcctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451079 - DNA, 598 bp, Homo sapiens
ctcatggccgactcttgaggataaaactaatgttcggacccaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcaggtggtggggacagcagaggtg

SEQ ID NO: 451080 - DNA, 6473 bp, Homo sapiens
cttacattatggacgtggacaccagaggggctgtgggccttatcctggccaccccgcctgtgggacggggcccatgggctgctcctctcagagtgaagcctttgtgggatgagaaagtgccgtgctcatgagtctggatcctcttctctcctactccagctgcatgtctgaaaagcgacgtcaccttgttgttaaagccatggtggtccagcgtgctctgtctttccaggtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctacagagtgtccggcagtggtaccagcagcagctcgccctggcacaggaggcccgcgtcaggctgcagggtgagatggcccacatccaggttggacagatgacccaggctggtatcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451081 - DNA, 4403 bp, Homo sapiens
agccatcagtgtaatgtctgtgtagttgcatccccctcctggagccctcagtgtaacatctgtgtagatgtgtccccctgctgtagccctcagtgtaatattcatgcacatgcatccccctcttggagccctcagtgtaacatctgtgcagacacattcccctcctatagtcctcagtgtaacaactctgcagatgtgtcctttcctggagccctcagtgtaacatctctgcagatgtgtccccttctggagccctcagtgtaacaactctgcagatgtgtcctttcctggagctctcagtgtaacatcgctgcagatgtggccccttctggagccctcagtgtaacatctctgcagatgtggcccctcctggagccctcagtgtaacatctgtgtagatgtgtccccctgctgtagccttcagtgtaacatctgtgcagacagattcccctcctggagccgtcagtgtaatgtctgtgcacatgtctcccacaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451082 - DNA, 6112 bp, Homo sapiens
cacgtctccgccggagcatccgggccgggcggcctccggggctgccagagcagcaggagactgggtgtgttgctgtattgcccaggctggtgtggaactcctggcctcaagcgatcctcccaccccagcctcccaaagtgctggtgttacaggcagtataccttaaatggcaagaaggaaataaatcatctgacatcactcagattgaagaggagctttttttcccccgattgccttaagaagtagcatactttcccaagtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctacagagtgtccggcagtggtaccagcagcagctcgccctggcacaggaggcccgcgtcaggctgcagggtgagatggcccacatccaggttggacagatgacccaggctggtatcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaacgtcaagtctgagttggagatggcccaggaagacctgtccatgacccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagat

SEQ ID NO: 451083 - DNA, 4385 bp, Homo sapiens
  misc_feature (4250)..(4250): n is a, c, g, or t
gagcaaggaagattcaggacaggggactccgcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgttttttttgatagccatcccaccataggatgtgtacatagatactgaatatcataatccaatctttgtttttttttttttttttttttgagacagagtctcgctttgttgcccaggctggagtgcagtggcacactctccgctcactgcaagctccgcctcccaggttcatgcgattctcctgcctcagcctctcgagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagataaaaaaaaaaaaaccggggctcattttcgggggggggaaaaaaggggtattggaagtggcccttggtccttacgttgttccctggaccacgttttcttgggacagggtggcagatcgccggcccccaagaggaggccattaatacagaagcagtaaccgagtttggtctcgcaccaaaanacacaaccacgatacacacagcgacactacaacaaacggtcacaatacacagcacgaatcatacacaaacaacactgaaccacgaacagaaagtacaacaaatcaacatcacacacatgaacatacccggacaag

SEQ ID NO: 451084 - DNA, 1206 bp, Homo sapiens
cacgtctccgccggagcatccgggccgggcggcctccggggctgccagagcagcaggagactgggtgtgttgctgtattgcccaggctggtgtggaactcctggcctcaagcgatcctcccaccccagcctcccaaagtgctggtgttacaggcagtataccttaaatggcaagaaggaaataaatcatctgacatcactcagattgaagaggagctttttttcccccgattgccttaagaagtagcatactttcccaagtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggctctacagattctcccctgcccctggagaaggaggagcaggtccgacttcaggctcggaagtggctggaagagcagctcaaacagtacagggtgaagcgccagcaggagagggtgagtctccctctcccgaacaagctcatggaaagcttcctgtgccagagacaactgttggtcccacataacccggggacctgccattggcttctctgagctgccatgggctcaggggcaacaagcacattttatttctaaatctgccaattgaaaagcaaagaaagcaaacacgggtgacctcagaggtactgtgggttcagttctggaccaccacaaaaatgtaaacattgcaataaagcaagtcctacaatgtttttggtttcctagtgcataaagaagttatgtgtatacgctactgtagtttactaagtgtgcagtagcactgtgtctaaataaaactgatgtacccacattaaaatgaa

SEQ ID NO: 451085 - DNA, 487 bp, Homo sapiens
tttgcagcgcaaagaagaggaggatcgccagatgaagcatcttgtccaggccctgcaggcctcactagagaaggagaaggagaaggtgaacagcctcaaggagcaggtgcgtgccaccttccgtctcacagggcgttccagaggacgctccagtgcctagaaatctatgcagggtccttcacacaccagcctccttccagcagttacacagagcaaaggtgtgttgcagttgttggtgacggaggccgcagagcacctgctctggtccgtagaaggtggcgttagattaaatggcagtgcagctgtgagggcctggggccaatgagctccgcgtgcatgtgtatttatattgtgctgggagtggtgtcctgtatgtcgtgttgcattgcaaaagcaaacttgagaatagcatatgatcccatttgtgttcggcagataagaggggtggttctgtggacccttctctgtgtagagagctgtcttttcg

SEQ ID NO: 451086 - DNA, 1499 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451087 - DNA, 755 bp, Homo sapiens
  misc_feature (446)..(446): n is a, c, g, or t
  misc_feature (450)..(450): n is a, c, g, or t
  misc_feature (452)..(452): n is a, c, g, or t
  misc_feature (457)..(457): n is a, c, g, or t
  misc_feature (470)..(470): n is a, c, g, or t
  misc_feature (474)..(474): n is a, c, g, or t
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactnaaanancaaanaaaaaaaaaaaanaaanaaaaaaaatttttggggggttgggccctgaaagaagagtttttaagaaccacttccgtgggggcgcggcggccccattggtgtaagtgaacacggtgcctagacacctggtccccagaggaaacaccgggggccaggaacagaggcgcgggctatcctccaccaatataaaaaagaccccggggggaacaccgagacggttcgggaacaaatcccaaagggacccgcgaagccaagagggggaccaaccccagagaccccagggactcgaataaaagagcc

SEQ ID NO: 451088 - DNA, 812 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggaataaagatggcatatagcataccagagattcattccaactagcattccaactctgacagtgacaccaagaatgttttcctgggactgcctggtgcttgttctccctggcattgtcttcaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaaggtatttgtaaatttacctgcttctgagtattagattgtgaatggcagggcctaactgttccttgtcctagatcaagcaaagactgttatagttttgtcttctggtcaccaagaagctgtggttttcagtagagcagttgccatttcaaagcagaatgttgttgtttaagaagtagaccttaactttgctttgttaaaacttttatatgccaacaaagactgttattgcataggatcattttttttctttgaacataaagaattttatcactgaattaaatccagatgtagtgtatttagccttgagtatatatttaattttttccaaggctcttaaggaa

SEQ ID NO: 451089 - DNA, 373 bp, Homo sapiens
taggggcagggagagggaaaggtctttttttaaaccaagcccctcatttcaatgtacaaaagaattactctgatcgatattaaatcgtattgaaaacaaaatggcctaaaaagcaaatacttctctatgttggggtggaagtgggaggaaagaatgagtccttccaagccggaagggagataccaggggaaaggttttgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451090 - DNA, 737 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggaataaagatggcatatagcataccagagattcattccaactagcattccaactctgacagtgacaccaagaatgttttcctgggactgcctggtgcttgttctccctggcattgtcttcaggtgaaacaaatagagaagagagactcggttctaacttcgaaaaatcagattgaaagactgacccgtcctggttcctcttacttcaatttgaacccatttgagtcttcaggataggatcctgaagttaacagaaaaaaaaaaaaaaaaaaaaaaaaaaacacgtgtgtgtggggcgcgccgagggccccccgagagaagagtttcgaaagagacccatcgcgtgggggcgcgcgggggccccaggagggaagggagacaacggggacataagcggggctgcccaagggaaacccggggaccaggacacagggcggggaattgcgcacacaaatataaaaaagacggcccgcgggggacaaaacggaaccgttgccgcgaacacaatccccagatgggcgagtctcgaggggcacaatacagggggacacctaagcaacggagggagtcccagagggaactgcggcgaagcccaatatacagcccggcctcga

SEQ ID NO: 451091 - DNA, 1621 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggaataaagatggcatatagcataccagagattcattccaactagcattccaactctgacagtgacaccaagaatgttttcctgggactgcctggtgcttgttctccctggcattgtcttcaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451092 - DNA, 1784 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaagccattgatgtacttttccttgtactctcccttgtgggtcccttgtctggcttggctgaaccccaaaatgctttggggttggacagacctggctgaaccttagtttcttcatctatgaaatgggaatatgaattactgcagcagcttttagggcagatttgccatggcatatacaaggtaactaccatagtgctccttgggtattgccaatatcctattatttctgtgtaaaatgaagatactgattgttttgaggattaaatgaagtaatatatgaaaaaaaaa

SEQ ID NO: 451093 - DNA, 2031 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaaaaaaaaaaaaaaaaaaaaaaaaaaaaaacggggggctttaattgggggggggaaaaaaggggtatagaaggggcagggggtccaacatagcgtgtttctcactgaaccccaggtcttcgttgttacaagagggggagaaaatcgacgaggatcaacccaatagggggagcgatctaaaatgcgcaatagggcccggtttaccccgggatttagtggattccaccacaggcgagacggaacagacgcgagaagacacacgagcggagaaccaggggagcacaccaacaggaagaaaacgcggagaaggcagaaagaaacaagaagacggaaagaaaagaaagacgccacaaaaaatgacaaaagagaaaaggaacgaagaaaagaaacgacaagagaagcgaggaagaagaaagagaacgacgacagaaagagagcgcggaaaaggcactgaaggacagtgaggcaaaaagacgcagaagaggaacagcaacagagaagaaggcagaaagcagcagaacaccaccagcacaca

SEQ ID NO: 451094 - DNA, 1517 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctggcaatttgattatacaagctcgggtggggatatttttcttgtttgatggtattaataagtttattcc

SEQ ID NO: 451095 - DNA, 1407 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451096 - DNA, 1094 bp, Homo sapiens
cctgattaagccaccccaggaaagaatcgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451097 - DNA, 1245 bp, Homo sapiens
gcacgagtgcatgccaaaaccaatgcctgccaaacaaaatcttagacatcccaatataatatgttagttatatttctattcacatcattattgaaaatacccagctcagtgcctggcttaataaatgtttaattcccttacctactcttgctctatttttttatttgaaatggagatgagcaaaataacacattcatggctgaagcaattttttggacatttcttgttaccaaaagatctataatcaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451098 - DNA, 1063 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451099 - DNA, 1011 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgacgctttacaggaagcatggctggggaggcctcaggaaacttaacagttgtggcagaaggtgaagaggaaggaggcacgtcttacatggccggagcaggaggaagagagcgcagggagaggtgctgtacgcttttaaacaaccagatctcactatctggatagtgatagataagaactcactatcacaagaacagcaaaggggg

SEQ ID NO: 451100 - DNA, 1119 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggaataaagatggcatatagcataccagagattcattccaactagcattccaactctgacagtgacaccaagaatgttttcctgggactgcctggtgcttgttctccctggcattgtcttcaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaaggtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgagggaaagtcgagatggtcagggtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451101 - DNA, 699 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451102 - DNA, 864 bp, Homo sapiens
ctagtttctagatcgtgagcgccgtccttttgttcatttgttggggacttggttcgcattaaaatatttatgattctaaaaacctactcgcgctgggcgcgcgtaggaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaagccattgatgtacttttccttgtactctcccttgtgggtcccttgtctggcttggctgaaccccaaaatgctttggggttggacagacctggctgaaccttagtttcttcatctatgaaatgggaatatgaattactgcagcagcttttagggcagatttgccatggcatatacaaggtaactaccatagtgctccttgggtattgccaatatcctattatttctgtgtaaaatgaagatactgattgttttgaggattaaatgaagtaatatatgaaaaaaaaa

SEQ ID NO: 451103 - DNA, 368 bp, Homo sapiens
ataagtagtctgtttcaaagactttttggatctgatgagttggggacaacctcccgttggtcccctttcatctttcattcttcctggtagattggattttagatgagattagaaaaaggacttgtggttcctaattttccttgattctgttgttcttttgaggagggaggggaggggctctttttttttttaatgaaaactttttgctatacccgtgcctatagaaagttaaatatattgtatgtgtacagcccagtggatattctcaaagcacagatgctcgtcttttgatgaaaaaaaattctttttaggtgaaagagcgaaaaaaacaattaaagaaggaaggaaaacctacaattgtagaggag

SEQ ID NO: 451104 - DNA, 846 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaattgggcctttctgagaccaccaaaggtgtatttccttctgcttgaaggactatttttcctccacttcaccccactaaagagtattgca

SEQ ID NO: 451105 - DNA, 637 bp, Homo sapiens
  misc_feature (595)..(595): n is a, c, g, or t
  misc_feature (637)..(637): n is a, c, g, or t
cctgattaagccaccccaggaaagaatcgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttttgtngctgcttctctccccgcctgtacttagtgttttgactccctn

SEQ ID NO: 451106 - DNA, 1738 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaagccattgatgtacttttccttgtactctcccttgtgggtcccttgtctggcttggctgaaccccaaaatgctttggggttggacagacctggctgaaccttagtttcttcatctatgaaatgggaatatgaattactgcagcagctcgcccctgagttagcagctcgcccctgagttagcagctcgttcctgagttagcagctcgcccctgagttagcagctcgccctgagtcagcagt

SEQ ID NO: 451107 - DNA, 1582 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaaaaaaaaaattacaaaccgaaagcggccggaaccttatcccctttagggaggggtaaattttaacttggcccttggccgtcgtt

SEQ ID NO: 451108 - DNA, 1977 bp, Homo sapiens
  misc_feature (1500)..(1500): n is a, c, g, or t
  misc_feature (1504)..(1504): n is a, c, g, or t
  misc_feature (1506)..(1506): n is a, c, g, or t
  misc_feature (1511)..(1511): n is a, c, g, or t
  misc_feature (1524)..(1524): n is a, c, g, or t
  misc_feature (1528)..(1528): n is a, c, g, or t
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaanaaanancaaanaaaaaaaaaaaanaaanaaaaaaaataaaaaaaaaaaaaaaaaaaaaaaaaaagaggggggggcgccgcccaaaaaatctcccccggggggccccatctcttgcccccccccccctttttttgtaaaaagggcggcccccaaaaagaggggcactctatataaaaaaaacagaacacgagcggccgggcgctgcttctatcaaaacacaagcctgtcgccgatggcgtggtaacaaaaccagctgctcctgtggtcgacctaatgttgtgagcgaagagcaacccccactattgtgggggccggtggacactatattggatgcacacacccaactcagaagaagtgtttaatagttcctcaggaggaacattcaacatctgcgcgtatctagtggtgtacaacccaccgagttttgttcgcgcgcgaaaaatattgtgtcgtcgtatatttctgaaatttacaaga

SEQ ID NO: 451109 - DNA, 1172 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgctta

SEQ ID NO: 451110 - DNA, 1343 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagacgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451111 - DNA, 1092 bp, Homo sapiens
gcgacgcattcggcatgaggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgagggaaagtcgagatggtcagggtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 451112 - DNA, 928 bp, Homo sapiens
tgagatggagtcttgctctgttgccagactggagtgcagtggtgcgatctgggctcactgcaatctccacctcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaaattccatatattttaaaaatcaagacccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatgaagtgatgtaattgaacttgccatgtctaaaattaaatttcatatttttttcaatcaaa

SEQ ID NO: 451113 - DNA, 3283 bp, Homo sapiens
accaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaacataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcaccccaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaaattccatatattttaaaaatcaagacccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatgaagtgatgtaattgaacttgccatgtctaaaattaaatttcatatttttttcaatcaaa

SEQ ID NO: 451114 - DNA, 6189 bp, Homo sapiens
cagcgctgtgcttcgccgtgagccgctcgctgctgctgacgtgcctggtgccggccgcgctgctgggcctgcgctactactacagccgcaaggtgatccgcgcctacctggagtgcgcgctgcacacggacatggcggacatcgagcagtactacatgaagccgcccggctcctgcttctgggtggccgtgctggatggcaacgtggtgggcattgtggctgcacgggcccacgaggaggacaacacggtggagctgctgcggatgtctgtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccggaccgcccgcccggcctgccctgtgcgccttgtgccgcctgcccgccgcccggcgcggcctgctttcagacgctcacttggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggcccgagctggccacggcgctgctttgctccgcgcatgccgagggtgtggcccggctgagcatgccgcatgcacacaggcccgccctgccgccctgcccagactggacccggagacccgggctggtgagcgcccctgtccccagcccccagctggctgtgggagggcctgcccctgcacccacctcctggagggactggtctgacccgcgccgcccggctctgtccacacctgctttgctctgacgccctccatttctctggctccggcccctcccctgcctgggctgtgctgactggtgtcatcacccaggtgactcccatggcgtccgtggcacagccagggtgggggtccatgggacccctctccccagtgcccactggatcgtgctggcctctcccagatgtccccggggacctcctgcctctggctgacggtccaccctgtgaatcttatcagcccaggctgctgccaacagcgcccagcccacagcttctcccagcctgaaaccaacacattttctaataagttatttagacagaatagcactctgcatgactttaattcttgggacaaaacggtagtttgtaccctaagacacagtttctggcccagtgtgatgggggtgggtggccgggtgggtggagcgtttgctgttggaaacctggagggaaaccctgattggatgtcatttcctgccatggagcacgcctcccagccctggcctgcagggtgggcagggtggggggcaagggagtccgcagcctccgggaggaggggcagggcgctgccttgggctgggtgggaagaggggtggccgcctcggcttccgctggccatgctcctggtctctccttcctgaggtcacaggcaggggctgccctggacggggggcggggggggtggcctggaaggggagacagaggtggagggtggcacaggctgcacattcagcttagaagtggacctggctttggtggcaggagaagaataaacacttgcccagacccctttgtgtgggggaattggggaggggtcgtggcaggcagggtgggccacggaactgggtcccaggcatcaaggccacgtgcagggccatggagggatgcttctcacgaggcgcttcagaagcgagcgaagggacagagaagccctgcgtccaagggccttttgtcctgttagcaattgaggtgtgcagagcactgtacagaccccactcccctgtacattcctccctggaggtgcccggtccccgcttggggatgggagttttgtagactgtacagaaatcggcaccctattttcttgcagctcagattttgttaatctggaatatacagacagacgtaaagtgttttagcaaaatggaaacaaacagttgtgcctttttcctcttttggtttggtttgggtttggcctggggctggtcccagttggtgcggggcatgctgggggcaggaggggcagggcgggccaggtggagtcaggtcttgggggtgtcatgtcggggtgctgccagcgtcccttggtcctgtgcctttggagcctcgggctcctggggtgcagggtgcttgggggtggctgttggagcccaccgacgccagggcagggcctggaggcccagggactgccagtgtctccttgatattgatcctagcagatccccctcctgggggttctgagagtcctgggcagtgtggccttctctcattctggtggcatctgcgcccgtgagtgacctcttccttggctgcactgccctgtgggtggtgagacgcttggccttttttgttgctgccaggacttggtagagatggcaggaagggtgtgcggggtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacctgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggccacccctctcctgctctgggtgtccttctcagagaagatggcagaaggctgcaggccctagaggggacgacgggctggggacgccctgagcttcctggctgtgtggcaggtgctggggaagctctctgggccatagggacctggctcccctctgagaggcccgcctgccctgggacacccagggctgtgctggtggcctgaggctgggaacttgggttcctgggctctgctggcgcctgggctttgtgggggccgaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccacggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtgtgcaagtgggttcttggatatgtgtagtgtgagcatgtgtgcatgtgtgagcctgtgcacgtgcatgttgtaggtgcataagcatgtacacgcgtgagcatgcatgtgcgtgtacacgtgtataggtgtacatgtgcatgagttgtgtacatgcgtgagcacgtgtatagatgtacgtgtgtgtgcgcatgtgtgcgtgtacatgtgtttgtgtcttgggtatgcataagcatgcacgtgtgtatgaatgtgcgtgtgtatgcatgagcacgtatgcatgtgtgatgcgcatgttcttgtgtacttctctgagggggcacatatgtatgagtgtatgagtgcatacatatgcatatggtgtacgtgtgtgtactttgtgtgtgggcatgtatgcgtatgagtacttgtgtgtggctggtgtatgggtgagcatgcacatgtgtatggatgcatatgtgagctgtacatgtagagtgtacatgtgtgttgcatgagcatgcatgcgtgcgagtgcctgtgtgtgtacttgcatatatgtggctgtgcaggtacccggcggtggtgggctggcagtgcccggggaagcaggtcctgctcacggcttccctgctgggccccaggccccgggctgagcctccctggcccctcttgcccctcagtggagcagggcctgggtggagggcctgggcagctccagggcaggtccggggaggccaggcttggggagcacagggggtggggttcacctgctgctgtttgttcccgaaactgtactgtgagcccacggcgggggcagattgttctgaggccccagatgtgccaaaacagcccccagggtgggggcgagcgagttctgaggagaggggctgcgggggccgggggtgggtgtgtgcccctcccctgaatggcccccaatgctgctgtttttcaataaaaccagagttgaaggcaaaaaaaaaaaaaaaaaaaaaaaaaaaaaaaaaccagcaaacaaccacaaacaaagggggggcgcacacacaagccacccccacccgaggggccccacacacgcgcggcacaacaacgccccgctgccccaccaggcggcacccacaaggacgcccccaatcaacacacaaaaggacaccggcgacagccaaacaacacgcgcaacaggcgcaccaaccccccccccgggaacccccgcacagacacaccaaccgagagacgccacacaaaacgagccacaccacaccacgagcacacaaagcgcccgccgggccacatcaccacaccacacggcgccccgcggcgcgacacaacacgcgccacaccgccgccccgcccgaaagacagccgcaccgccgacatacacctgcaacacatacaccagagcccacccagcacaagcggcgcagcaccgccgccacagcgccgagccccacagccacgcgccgccggcgcggcacgagccggacagcgcacaagtgggagaagcaagacgaggcagaacacgccacgaccgccgcaagaccaccgcgcgaacccgccgccgcgcggagccaggacacgagagcacgcaacaggacccgaaccgacgagacagaaacagcagaaccgaacctcgcgtacaagagcgaacgccaacagaggcgag

SEQ ID NO: 451115 - DNA, 5122 bp, Homo sapiens
cagcgctgtgcttcgccgtgagccgctcgctgctgctgacgtgcctggtgccggccgcgctgctgggcctgcgctactactacagccgcaaggtgatccgcgcctacctggagtgcgcgctgcacacggacatggcggacatcgagcagtactacatgaagccgcccggctcctgcttctgggtggccgtgctggatggcaacgtggtgggcattgtggctgcacgggcccacgaggaggacaacacggtggagctgctgcggatgtctgtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccggaccgcccgcccggcctgccctgtgcgccttgtgccgcctgcccgccgcccggcgcggcctgctttcagacgctcacttggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggcccgagctggccacggcgctgctttgctccgcgcatgccgagggtgtggcccggctgagcatgccgcatgcacacaggcccgccctgccgccctgcccagactggacccggagacccgggctggtgagcgcccctgtccccagcccccagctggctgtgggagggcctgcccctgcacccacctcctggagggactggtctgacccgcgccgcccggctctgtccacacctgctttgctctgacgccctccatttctctggctccggcccctcccctgcctgggctgtgctgactggtgtcatcacccaggtgactcccatggcgtccgtggcacagccagggtgggggtccatgggacccctctccccagtgcccactggatcgtgctggcctctcccagatgtccccggggacctcctgcctctggctgacggtccaccctgtgaatcttatcagcccaggctgctgccaacagcgcccagcccacagcttctcccagcctgaaaccaacacattttctaataagttatttagacagaatagcactctgcatgactttaattcttgggacaaaacggtagtttgtaccctaagacacagtttctggcccagtgtgatgggggtgggtggccgggtgggtggagcgtttgctgttggaaacctggagggaaaccctgattggatgtcatttcctgccatggagcacgcctcccagccctggcctgcagggtgggcagggtggggggcaagggagtccgcagcctccgggaggaggggcagggcgctgccttgggctgggtgggaagaggggtggccgcctcggcttccgctggccatgctcctggtctctccttcctgaggtcacaggcaggggctgccctggacggggggcggggggggtggcctggaaggggagacagaggtggagggtggcacaggctgcacattcagcttagaagtggacctggctttggtggcaggagaagaataaacacttgcccagacccctttgtgtgggggaattggggaggggtcgtggcaggcagggtgggccacggaactgggtcccaggcatcaaggccacgtgcagggccatggagggatgcttctcacgaggcgcttcagaagcgagcgaagggacagagaagccctgcgtccaagggccttttgtcctgttagcaattgaggtgtgcagagcactgtacagaccccactcccctgtacattcctccctggaggtgcccggtccccgcttggggatgggagttttgtagactgtacagaaatcggcaccctattttcttgcagctcagattttgttaatctggaatatacagacagacgtaaagtgttttagcaaaatggaaacaaacagttgtgcctttttcctcttttggtttggtttgggtttggcctggggctggtcccagttggtgcggggcatgctgggggcaggaggggcagggcgggccaggtggagtcaggtcttgggggtgtcatgtcggggtgctgccagcgtcccttggtcctgtgcctttggagcctcgggctcctggggtgcagggtgcttgggggtggctgttggagcccaccgacgccagggcagggcctggaggcccagggactgccagtgtctccttgatattgatcctagcagatccccctcctgggggttctgagagtcctgggcagtgtggccttctctcattctggtggcatctgcgcccgtgagtgacctcttccttggctgcactgccctgtgggtggtgagacgcttggccttttttgttgctgccaggacttggtagagatggcaggaagggtgtgcggggtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacctgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggccacccctctcctgctctgggtgtccttctcagagaagatggcagaaggctgcaggccctagaggggacgacgggctggggacgccctgagcttcctggctgtgtggcaggtgctggggaagctctctgggccatagggacctggctcccctctgagaggcccgcctgccctgggacacccagggctgtgctggtggcctgaggctgggaacttgggttcctgggctctgctggcgcctgggctttgtgggggccgaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccacggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtgtgcaagtgggttcttggatatgtgtagtgtgagcatgtgtgcatgtgtgagcctgtgcacgtgcatgttgtaggtgcataagcatgtacacgcgtgagcatgcatgtgcgtgtacacgtgtataggtgtacatgtgcatgagttgtgtacatgcgtgagcacgtgtatagatgtacgtgtgtgtgcgcatgtgtgcgtgtacatgtgtttgtgtcttgggtatgcataagcatgcacgtgtgtatgaatgtgcgtgtgtatgcatgagcacgtatgcatgtgtgatgcgcatgttcttgtgtacttctctgagggggcacatatgtatgagtgtatgagtgcatacatatgcatatggtgtacgtgtgtgtactttgtgtgtgggcatgtatgcgtatgagtacttgtgtgtggctggtgtatgggtgagcatgcacatgtgtatggatgcatatgtgagctgtacatgtagagtgtacatgtgtgttgcatgagcatgcatgcgtgcgagtgcctgtgtgtgtacttgcatatataggctgatctcgaactcctgacctcaagtgatctgc

SEQ ID NO: 451116 - DNA, 5501 bp, Homo sapiens
cagcgctgtgcttcgccgtgagccgctcgctgctgctgacgtgcctggtgccggccgcgctgctgggcctgcgctactactacagccgcaaggtgatccgcgcctacctggagtgcgcgctgcacacggacatggcggacatcgagcagtactacatgaagccgcccggctcctgcttctgggtggccgtgctggatggcaacgtggtgggcattgtggctgcacgggcccacgaggaggacaacacggtggagctgctgcggatgtctgtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccggaccgcccgcccggcctgccctgtgcgccttgtgccgcctgcccgccgcccggcgcggcctgctttcagacgctcacttggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggcccgagctggccacggcgctgctttgctccgcgcatgccgagggtgtggcccggctgagcatgccgcatgcacacaggcccgccctgccgccctgcccagactggacccggagacccgggctggtgagcgcccctgtccccagcccccagctggctgtgggagggcctgcccctgcacccacctcctggagggactggtctgacccgcgccgcccggctctgtccacacctgctttgctctgacgccctccatttctctggctccggcccctcccctgcctgggctgtgctgactggtgtcatcacccaggtgactcccatggcgtccgtggcacagccagggtgggggtccatgggacccctctccccagtgcccactggatcgtgctggcctctcccagatgtccccggggacctcctgcctctggctgacggtccaccctgtgaatcttatcagcccaggctgctgccaacagcgcccagcccacagcttctcccagcctgaaaccaacacattttctaataagttatttagacagaatagcactctgcatgactttaattcttgggacaaaacggtagtttgtaccctaagacacagtttctggcccagtgtgatgggggtgggtggccgggtgggtggagcgtttgctgttggaaacctggagggaaaccctgattggatgtcatttcctgccatggagcacgcctcccagccctggcctgcagggtgggcagggtggggggcaagggagtccgcagcctccgggaggaggggcagggcgctgccttgggctgggtgggaagaggggtggccgcctcggcttccgctggccatgctcctggtctctccttcctgaggtcacaggcaggggctgccctggacggggggcggggggggtggcctggaaggggagacagaggtggagggtggcacaggctgcacattcagcttagaagtggacctggctttggtggcaggagaagaataaacacttgcccagacccctttgtgtgggggaattggggaggggtcgtggcaggcagggtgggccacggaactgggtcccaggcatcaaggccacgtgcagggccatggagggatgcttctcacgaggcgcttcagaagcgagcgaagggacagagaagccctgcgtccaagggccttttgtcctgttagcaattgaggtgtgcagagcactgtacagaccccactcccctgtacattcctccctggaggtgcccggtccccgcttggggatgggagttttgtagactgtacagaaatcggcaccctattttcttgcagctcagattttgttaatctggaatatacagacagacgtaaagtgttttagcaaaatggaaacaaacagttgtgcctttttcctcttttggtttggtttgggtttggcctggggctggtcccagttggtgcggggcatgctgggggcaggaggggcagggcgggccaggtggagtcaggtcttgggggtgtcatgtcggggtgctgccagcgtcccttggtcctgtgcctttggagcctcgggctcctggggtgcagggtgcttgggggtggctgttggagcccaccgacgccagggcagggcctggaggcccagggactgccagtgtctccttgatattgatcctagcagatccccctcctgggggttctgagagtcctgggcagtgtggccttctctcattctggtggcatctgcgcccgtgagtgacctcttccttggctgcactgccctgtgggtggtgagacgcttggccttttttgttgctgccaggacttggtagagatggcaggaagggtgtgcggggtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacctgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggccacccctctcctgctctgggtgtccttctcagagaagatggcagaaggctgcaggccctagaggggacgacgggctggggacgccctgagcttcctggctgtgtggcaggtgctggggaagctctctgggccatagggacctggctcccctctgagaggcccgcctgccctgggacacccagggctgtgctggtggcctgaggctgggaacttgggttcctgggctctgctggcgcctgggctttgtgggggccgaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccacggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtgtgcaagtgggttcttggatatgtgtagtgtgagcatgtgtgcatgtgtgagcctgtgcacgtgcatgttgtaggtgcataagcatgtacacgcgtgagcatgcatgtgcgtgtacacgtgtataggtgtacatgtgcatgagttgtgtacatgcgtgagcacgtgtatagatgtacgtgtgtgtgcgcatgtgtgcgtgtacatgtgtttgtgtcttgggtatgcataagcatgcacgtgtgtatgaatgtgcgtgtgtatgcatgagcacgtatgcatgtgtgatgcgcatgttcttgtgtacttctctgagggggcacatatgtatgagtgtatgagtgcatacatatgcatatggtgtacgtgtgtgtactttgtgtgtgggcatgtatgcgtatgagtacttgtgtgtggctggtgtatgggtgagcatgcacatgtgtatggatgcatatgtgagctgtacatgtagagtgtacatgtgtgttgcatgagcatgcatgcgtgcgagtgcctgtgtgtgtacttgcatatatgtggctgtgcaggtacccggcggtggtgggctggcagtgcccggggaagcaggtcctgctcacggcttccctgctgggccccaggccccgggctgagcctccctggcccctcttgcccctcagtggagcagggcctgggtggagggcctgggcagctccagggcaggtccggggaggccaggcttggggagcacagggggtggggttcacctgctgctgtttgttcccgaaactgtactgtgagcccacggcgggggcagattgttctgaggccccagatgtgccaaaacagcccccagggtgggggcgagcgagttctgaggagaggggctgcgggggccgggggtgggtgtgtgcccctcccctgaatggcccccaatgctgctgtttttcaataaaaccagagttgaaggca

SEQ ID NO: 451117 - DNA, 4615 bp, Homo sapiens
  misc_feature (4584)..(4584): n is a, c, g, or t
  misc_feature (4601)..(4601): n is a, c, g, or t
cagcgctgtgcttcgccgtgagccgctcgctgctgctgacgtgcctggtgccggccgcgctgctgggcctgcgctactactacagccgcaaggtgatccgcgcctacctggagtgcgcgctgcacacggacatggcggacatcgagcagtactacatgaagccgcccggctcctgcttctgggtggccgtgctggatggcaacgtggtgggcattgtggctgcacgggcccacgaggaggacaacacggtggagctgctgcggatgtctgtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccggaccgcccgcccggcctgccctgtgcgccttgtgccgcctgcccgccgcccggcgcggcctgctttcagacgctcacttggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggcccgagctggccacggcgctgctttgctccgcgcatgccgagggtgtggcccggctgagcatgccgcatgcacacaggcccgccctgccgccctgcccagactggacccggagacccgggctggtgagcgcccctgtccccagcccccagctggctgtgggagggcctgcccctgcacccacctcctggagggactggtctgacccgcgccgcccggctctgtccacacctgctttgctctgacgccctccatttctctggctccggcccctcccctgcctgggctgtgctgactggtgtcatcacccaggtgactcccatggcgtccgtggcacagccagggtgggggtccatgggacccctctccccagtgcccactggatcgtgctggcctctcccagatgtccccggggacctcctgcctctggctgacggtccaccctgtgaatcttatcagcccaggctgctgccaacagcgcccagcccacagcttctcccagcctgaaaccaacacattttctaataagttatttagacagaatagcactctgcatgactttaattcttgggacaaaacggtagtttgtaccctaagacacagtttctggcccagtgtgatgggggtgggtggccgggtgggtggagcgtttgctgttggaaacctggagggaaaccctgattggatgtcatttcctgccatggagcacgcctcccagccctggcctgcagggtgggcagggtggggggcaagggagtccgcagcctccgggaggaggggcagggcgctgccttgggctgggtgggaagaggggtggccgcctcggcttccgctggccatgctcctggtctctccttcctgaggtcacaggcaggggctgccctggacggggggcggggggggtggcctggaaggggagacagaggtggagggtggcacaggctgcacattcagcttagaagtggacctggctttggtggcaggagaagaataaacacttgcccagacccctttgtgtgggggaattggggaggggtcgtggcaggcagggtgggccacggaactgggtcccaggcatcaaggccacgtgcagggccatggagggatgcttctcacgaggcgcttcagaagcgagcgaagggacagagaagccctgcgtccaagggccttttgtcctgttagcaattgaggtgtgcagagcactgtacagaccccactcccctgtacattcctccctggaggtgcccggtccccgcttggggatgggagttttgtagactgtacagaaatcggcaccctattttcttgcagctcagattttgttaatctggaatatacagacagacgtaaagtgttttagcaaaatggaaacaaacagttgtgcctttttcctcttttggtttggtttgggtttggcctggggctggtcccagttggtgcggggcatgctgggggcaggaggggcagggcgggccaggtggagtcaggtcttgggggtgtcatgtcggggtgctgccagcgtcccttggtcctgtgcctttggagcctcgggctcctggggtgcagggtgcttgggggtggctgttggagcccaccgacgccagggcagggcctggaggcccagggactgccagtgtctccttgatattgatcctagcagatccccctcctgggggttctgagagtcctgggcagtgtggccttctctcattctggtggcatctgcgcccgtgagtgacctcttccttggctgcactgccctgtgggtggtgagacgcttggccttttttgttgctgccaggacttggtagagatggcaggaagggtgtgcggggtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacctgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggccacccctctcctgctctgggtgtccttctcagagaagatggcagaaggctgcaggccctagaggggacgacgggctggggacgccctgagcttcctggctgtgtggcaggtgctggggaagctctctgggccatagggacctggctcccctctgagaggcccgcctgccctgggacacccagggctgtgctggtggcctgaggctgggaacttgggttcctgggctctgctggcgcctgggctttgtgggggccgaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccacggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtggggcacgtagggtctcgaggacagtgaagcccanggcaggtctcaacccgngctgccattgggct

SEQ ID NO: 451118 - DNA, 991 bp, Homo sapiens
ggcacgaggcgcgcgcgctcgcgcaccacgcgccccgcgcggcccgcccggatcgtggcctctcgagagcaagacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacatctgcagaatcctactggatgtccacttggatgtcctgaagccacctgaaactcagcatatctacgaatgatcaaatgggatgccagcactcagttatccaagcaagaaatatgctccatgcttgactctttaccctcactaacaaaactgggcaaagtcctgctggtctctctctttaatacttctcaaatctgtccctttagtttcatccctctgttactgttctcattcagattcttattacatctcaccaaagccactgcagcacattcttaactgtgtccaagtggtaataattaaaaacagcttactgtctttatcattatcactcttaacccaccctaaaatttcctaaaggtatcccgttgacctcaggatacattaaagctacttagtggtgactggtttctgcctaccacttcctcccctaccacctaacactcacacatacaaatacttggttcaactgtttgctctccttgaaatgaatgcctcctctgtgcccagctagcagttacccatcctttaaaactcatcccctctaagatgtgccctaccacctgcagatttgggttaagtgtctcaataaaatcttaaatgaataaatgcatggctaataagtt

SEQ ID NO: 451119 - DNA, 769 bp, Homo sapiens
ggcacgaggcgcgcgcgctcgcgcaccacgcgccccgcgcggcccgcccggatcgtggcctctcgagagcaagacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattagaaatgttgaggttggacaatacattagaggaaattatatttaagctggtccctggactacgagaacaagaacttgagcgtgaatctgaattttggaagaaaaataagcctcaagaaaatggacaagatgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaagggtttaactgacacgaaattccttcgatgttctaacacg

SEQ ID NO: 451120 - DNA, 1525 bp, Homo sapiens
  misc_feature (11)..(11): n is a, c, g, or t
agcgagtgggnggagttgcccttggaggcggcaccggacctgggccccgaggcccgccgcgccctgtcgggcctgagccgagtggccccacagagccggcgcgctcccgcctgcagggggagagcagacggggcgcggggaccggccaggccgcggcgggtgctgtttctgtttcactttccttcactctgaggccggcgcgctggcgggcgaggagcggcggcggtggcggccgctggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacatctgcagaatcctactggatgtccacttggatgtcctgaagccacctgaaactcagcatatctacgaatgatcaaatgggatgccagcactcagttatccaagcaagaaatatgctccatgcttgactctttaccctcactaacaaaactgggcaaagtcctgctggtctctctctttaatacttctcaaatctgtccctttagtttcatccctctgttactgttctcattcagattcttattacatctcaccaaagccactgcagcacattcttaactgtgtccaagtggtaataattaaaaacagcttactgtctttatcattatcactcttaacccaccctaaaatttcctaaaggtatcccgttgacctcaggatacattaaagctacttagtggtgactggtttctgcctaccacttcctcccctaccacctaacactcacacatacaaatacttggttcaactgtttgctctccttgaaatgaatgcctcctctgtgcccagctagcagttacccatcctttaaaactcatcccctctaagatgtgccctaccacctgcagatttgggttaagtgtctcaataaaatcttaaatgaataaatgcatggctaataagttattttattgtgtatttttcctttcaaagattcaaatgcagtgataggtaacttgaaacatgtaggcattgttggttaggaattacaaatttaggaaaactgtctcctaggatctacataggcatctttggggtcttagggagagggagagactctggactggggactagaaattgatggccctagattaagggatgttctgtctctttcaccaggtgaccctggtgaaaagagaaactttaaagctgcttagaatgtatctgctgggtggtataggttgttgatttaaaacaaaagactttttacttaaactaaggacaaaggggctatgttccagcagctcaaatgtgaccaatacagtgtattggt

SEQ ID NO: 451121 - DNA, 935 bp, Homo sapiens
  misc_feature (11)..(11): n is a, c, g, or t
agcgagtgggnggagttgcccttggaggcggcaccggacctgggccccgaggcccgccgcgccctgtcgggcctgagccgagtggccccacagagccggcgcgctcccgcctgcagggggagagcagacggggcgcggggaccggccaggccgcggcgggtgctgtttctgtttcactttccttcactctgaggccggcgcgctggcgggcgaggagcggcggcggtggcggccgctggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattagaaatgttgaggttggacaatacattagaggaaattatatttaagctggtccctggactacgagaacaagaacttgagcgtgaatctgaattttggaagaaaaataagcctcaagaaaatggacaagatgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaagggtttaactgacacgaaattccttcgatgttctaacacg

SEQ ID NO: 451122 - DNA, 659 bp, Homo sapiens
atgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaaggtgagtgaacaagtactatggtatttttatgatcagtttatagtaaacccttgataatttgttgacaaattttctaatgcttcaaaatgtttgctttcaaagttttaattaacataattaaataaaatgccattctttgacaatcctatgcttagaaatggttactattcccacaactgaactgtcttgggccaatgccaccatctagtggctaatgcccagaatcacacctctgtttctccttttatacctttgctggaaattcatatgcatggtttctgttttttagagtggtgaccaacttagacttagagaatttcatgtcactggtagttctagcccttttattcattctcttctaattttatcctttatttctctatttttatttgcaactcaacaagatttccatgtcagagctaacatattttgtgaataatttaatcaattagttttgaagtaaaattagatgttgtaaaatgcctctgaacttttaaactccttgaaggc

SEQ ID NO: 451123 - DNA, 371 bp, Homo sapiens
acatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacatgtaagtattcttttaggttattatacctatcaaagtttatatgtacattttgttcttttaaaattgccatgttttg

SEQ ID NO: 451124 - DNA, 1157 bp, Homo sapiens
  misc_feature (11)..(11): n is a, c, g, or t
agcgagtgggnggagttgcccttggaggcggcaccggacctgggccccgaggcccgccgcgccctgtcgggcctgagccgagtggccccacagagccggcgcgctcccgcctgcagggggagagcagacggggcgcggggaccggccaggccgcggcgggtgctgtttctgtttcactttccttcactctgaggccggcgcgctggcgggcgaggagcggcggcggtggcggccgctggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacatctgcagaatcctactggatgtccacttggatgtcctgaagccacctgaaactcagcatatctacgaatgatcaaatgggatgccagcactcagttatccaagcaagaaatatgctccatgcttgactctttaccctcactaacaaaactgggcaaagtcctgctggtctctctctttaatacttctcaaatctgtccctttagtttcatccctctgttactgttctcattcagattcttattacatctcaccaaagccactgcagcacattcttaactgtgtccaagtggtaataattaaaaacagcttactgtctttatcattatcactcttaacccaccctaaaatttcctaaaggtatcccgttgacctcaggatacattaaagctacttagtggtgactggtttctgcctaccacttcctcccctaccacctaacactcacacatacaaatacttggttcaactgtttgctctccttgaaatgaatgcctcctctgtgcccagctagcagttacccatcctttaaaactcatcccctctaagatgtgccctaccacctgcagatttgggttaagtgtctcaataaaatcttaaatgaataaatgcatggctaataagtt

SEQ ID NO: 451125 - DNA, 1125 bp, Homo sapiens
  misc_feature (11)..(11): n is a, c, g, or t
agcgagtgggnggagttgcccttggaggcggcaccggacctgggccccgaggcccgccgcgccctgtcgggcctgagccgagtggccccacagagccggcgcgctcccgcctgcagggggagagcagacggggcgcggggaccggccaggccgcggcgggtgctgtttctgtttcactttccttcactctgaggccggcgcgctggcgggcgaggagcggcggcggtggcggccgctggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacatctgcagaatcctactggatgtccacttggatgtcctgaagccacctgaaactcagcatatctacgaatgatcaaatgggatgccagcactcagttatccaagcaagaaatatgctccatgcttgactctttaccctcactaacaaaactgggcaaagtcctgctggtctctctctttaatacttctcaaatctgtccctttagtttcatccctctgttactgttctcattcagattcttattacatctcaccaaagccactgcagcacattcttaactgtgtccaagtggtaataattaaaaacagcttactgtctttatcattatcactcttaacccaccctaaaatttcctaaaggtatcccgttgacctcaggatacattaaagctacttagtggtgactggtttctgcctaccacttcctcccctaccacctaacactcacacatacaaatacttgctcctctgtgcccagctagcagttacccatcctttaaaactcatcccctctaagatgtgccctaccacctgcagatttgggttaagtgtctcaataaaatcttaaatgaataaatgcatggctaataagtt

SEQ ID NO: 451126 - DNA, 525 bp, Homo sapiens
ggcaagctggtgaaaggattcaccatcgccgcccgcaacggcgccgataccgcgacccacgcgcaccgcgattagggttagtactaaccctaatcgcccctttagtttcatccctctgttactgttctcattcagattcttattacatctcaccaaagccactgcagcacattcttaactgtgtccaagtggtaataattaaaaacagcttactgtctttatcattatcactcttaacccaccctaaaatttcctaaaggtatcccgttgacctcaggatacattaaagctacttagtggtgactggtttctgcctaccacttcctcccctaccacctaacactcacacatacaaatacttggttcaactgtttgctctccttgaaatgaatgcctcctctgtgcccagctagcagttacccatcctttaaaactcatcccctctaagatgtgccctaccacctgcagatttgggttaagtgtctcaataaaatcttaaatgaataaatgcatggctaataagtt

SEQ ID NO: 451127 - DNA, 2400 bp, Homo sapiens
gtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaagatatggacatttctggaattaagagccccctctacattgagcacaagacagtgacgaatccacattcttcagccagaaagtcacctctgagagccaaatgtctgactatagaaaggagagtcaaagaatgataacgacatctcaggaaaattgtgaaaataatcagcagccggatgtggataaccctttcaaatttctcctggggcctccaaccacccccactggtgttctcctgctgacagtgatttcaattttttctgggctggagctccctgatggaggggcaggccaccatctttgctgtttttgcaacttagccacttcagccttcagtctttggagtgtccaaggagaccagggggtgatgtggaccctcagcatagcacagctgctctataaagatgaggccagactgcttttttgagcactttcccaatgccattcctcctcactgggcaaaacctccaaactggggtctccagccacctcctacaggtgtgtttgggccagcaacaagttcattcatacctccctagggcaaagcttccaaagggagcggtaggctgccatctttgctgtttcacaggcttcactgatgataactccaggtactggaaaatctgaggctactagagactggagcgggccctgggcatactgcagcagccctatggaaaagtggccagactgttacctgggttcccattcctatatcttctcactaggcaagtcttgcaggcctgggcctctacctaaccccccctaccagaactgttgagccagtagcaactcagccactccctggagagagcctccaggggcaactgaaagcctctctgccactgcttctgcagtggaactgtccttgctaccctcagactgatgaaggagctaacacccttatctacaccttcaacaagctttaattgaccaaagcccatctctcatgggttctacacactccccactgctcatgacagggaacccctggattggcccccacagcacgaattctccatcctgattgctgattgcagtaaacagttgctgtattctccaggggtggtggaactctgaggagacaaacaaaagacccttggctacaaccactactaatgtcccttcctcttctgcctcaaagttaggaaagaaatataaacactgagattgccccagagctgcagtgggcagcctaggagtgccaagccatgacctacagccagcactcaagggggagagaagcacattttcagatcattgagagggaacatggctgcaactgtaaggaaacataggggagccacatgaccaagcaagagtctaccaactgaccagtaagcccaagtgccacctactggatcacatcccaaagcttcagcatcaaaaataccctactaatatactcccctctgaaaccagaaatgagaagtcagcttcaaataaagaccctgcacaaagcctcagcctggtgaaaacatccgaaaataagtctacggactgtactcaatctacactgcaattaaaggaaaacccataggtggaaatgagaagaaaccaatgcaagaactccagtaactcaaatggcctctgtgtcatatgtccttctaacaaccacaccagttctccaacaagagttcttaacctggatgaactgtctggaattacataaatataattcagaatatggataggaaaaaaaatcatcaagactcaggagaatggcaaaacccaatccaaggaaaataagaataacagtaaagtgttacaggagctgaaggataaagtagctggtataataaaaaagaacctaaccgatctgaaagcgccgaagaacacaatacaagaattccacaatgcaatcacaagtattaacagcagaaaaaaaaacctgaggaacgaatctcagaacttgaagattggttctctaaaataagatggac

SEQ ID NO: 451128 - DNA, 537 bp, Homo sapiens
gtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaaggtatgttgccaaaatttatgaattaaattcaaatcattgatttctgaaataaactctaagtagtgaacggtattccc

SEQ ID NO: 451129 - DNA, 2828 bp, Homo sapiens
gaagaatgttgtgttttagtcctagagcagggtctgtgaacttttctgtaaagggccagatagtgttatgtaaggctttgtgagccataagatccttgttgcaataactcggccctgcaattacagcacaaaagtagccatgaacaatatgcagactgaaggggtgtagcagtgtcccactaaaattacttacaaaaaacaggtaatgggatgatttctcctagattatgaccttttataaataaaaaagattgtgatagtctaaaatatttcatatatattttgttgattcattcatctactgatggacatttaggtcatttccaaatgtaattttttaaaattctttgtttcagtttcaagaaatacaggatcaacttacagctactataagatgtactaaggagatggaaggcgacacacaaaagtaaaatttgaagcagcacacaaaataacttgagtatttataaagcaaaagagcactgtagtatgaaaattgtatcagttatgataattagtatgtctttgtgaagccaaaaaagtttcatttgtaagctatatcgaaatacatcatttttctacattattcctaaattttgcatattatcaccaaaacacaggtagaaaatgacacagtagcccaatcgtctacttttgtgattgctaagaatttgtgtaattataccttcagaagtttgtttagaatttacatgatttaaaaaaaattacgtgtgagagtaattattttaaaatgcacattttaggcttgaagtagaacatgtgatgatgagaaaaattattaaaaaacaggatgaccaaattgagcggcttgagaaaatcctgcagcattcaagtttgatgctgcaggtgtttgagagctagatgaagatatggacatttctggaattaagagccccctctacattgagcacaagacagtgacgaatccacattcttcagccagaaagtcacctctgagagccaaatgtctgactatagaaaggagagtcaaagaatgataacgacatctcaggaaaattgtgaaaataatcagcagccggatgtggataaccctttcaaatttctcctggggcctccaaccacccccactggtgttctcctgctgacagtgatttcaattttttctgggctggagctccctgatggaggggcaggccaccatctttgctgtttttgcaacttagccacttcagccttcagtctttggagtgtccaaggagaccagggggtgatgtggaccctcagcatagcacagctgctctataaagatgaggccagactgcttttttgagcactttcccaatgccattcctcctcactgggcaaaacctccaaactggggtctccagccacctcctacaggtgtgtttgggccagcaacaagttcattcatacctccctagggcaaagcttccaaagggagcggtaggctgccatctttgctgtttcacaggcttcactgatgataactccaggtactggaaaatctgaggctactagagactggagcgggccctgggcatactgcagcagccctatggaaaagtggccagactgttacctgggttcccattcctatatcttctcactaggcaagtcttgcaggcctgggcctctacctaaccccccctaccagaactgttgagccagtagcaactcagccactccctggagagagcctccaggggcaactgaaagcctctctgccactgcttctgcagtggaactgtccttgctaccctcagactgatgaaggagctaacacccttatctacaccttcaacaagctttaattgaccaaagcccatctctcatgggttctacacactccccactgctcatgacagggaacccctggattggcccccacagcacgaattctccatcctgattgctgattgcagtaaacagttgctgtattctccaggggtggtggaactctgaggagacaaacaaaagacccttggctacaaccactactaatgtcccttcctcttctgcctcaaagttaggaaagaaatataaacactgagattgccccagagctgcagtgggcagcctaggagtgccaagccatgacctacagccagcactcaagggggagagaagcacattttcagatcattgagagggaacatggctgcaactgtaaggaaacataggggagccacatgaccaagcaagagtctaccaactgaccagtaagcccaagtgccacctactggatcacatcccaaagcttcagcatcaaaaataccctactaatatactcccctctgaaaccagaaatgagaagtcagcttcaaataaagaccctgcacaaagcctcagcctggtgaaaacatccgaaaataagtctacggactgtactcaatctacactgcaattaaaggaaaacccataggtggaaatgagaagaaaccaatgcaagaactccagtaactcaaatggcctctgtgtcatatgtccttctaacaaccacaccagttctccaacaagagttcttaacctggatgaactgtctggaattacataaatataattcagaatatggataggaaaaaaaatcatcaagactcaggagaatggcaaaacccaatccaaggaaaataagaataacagtaaagtgttacaggagctgaaggataaagtagctggtataataaaaaagaacctaaccgatctgaaagcgccgaagaacacaatacaagaattccacaatgcaatcacaagtattaacagcagaaaaaaaaacctgaggaacgaatctcagaacttgaagattggttctctaaaataagatggac

SEQ ID NO: 451130 - DNA, 1372 bp, Homo sapiens
gaagaatgttgtgttttagtcctagagcagggtctgtgaacttttctgtaaagggccagatagtgttatgtaaggctttgtgagccataagatccttgttgcaataactcggccctgcaattacagcacaaaagtagccatgaacaatatgcagactgaaggggtgtagcagtgtcccactaaaattacttacaaaaaacaggtaatgggatgatttctcctagattatgaccttttataaataaaaaagattgtgatagtctaaaatatttcatatatattttgttgattcattcatctactgatggacatttaggtcatttccaaatgtaattttttaaaattctttgtttcagtttcaagaaatacaggatcaacttacagctactataagatgtactaaggagatggaaggcgacacacaaaagtaaaatttgaagcagcacacaaaataacttgagtatttataaagcaaaagagcactgtagtatgaaaattgtatcagttatgataattagtatgtctttgtgaagccaaaaaagtttcatttgtaagctatatcgaaatacatcatttttctacattattcctaaattttgcatattatcaccaaaacacaggtagaaaatgacacagtagcccaatcgtctacttttgtgattgctaagaatttgtgtaattataccttcagaagtttgtttagaatttacatgatttaaaaaaaattacgtgtgagagtaattattttaaaatgcacattttaggcttgaagtagaacatgtgatgatgagaaaaattattaaaaaacaggatgaccaaattgagcggcttgagaaaatcctgcagcattcaagtttgatgctgcaggtgtttgagagctagatgaagcatccagccaaactagactacatggagctccacagtgatcgtcttcacctccagctgtttgcatttacttcttccctctatcctacatgtgttttccttccccttcagatatcaacctatgaattgcctctaccaaaaagcctacaatattgacacaaacctgggctagtatcccttctatgtcttccaataagtgctgtcttatgcttgtcattgtatgtatgactctgtatgggaattgcctgtttgttttttcagattatagcatacagttgttgaggggcggaccgtatcatctttatcttgtaattccagtgcttgtcctagtaccttagcacatggttgctgaatacatgaacgaagagtgagaaaccagaagctctgttacttaactgccatgataatgaattcggtgtgcaactatgggcaaattatatttaatagtaattgcatattgtacatatttttcattcttattaacact

SEQ ID NO: 451131 - DNA, 965 bp, Homo sapiens
gaagaatgttgtgttttagtcctagagcagggtctgtgaacttttctgtaaagggccagatagtgttatgtaaggctttgtgagccataagatccttgttgcaataactcggccctgcaattacagcacaaaagtagccatgaacaatatgcagactgaaggggtgtagcagtgtcccactaaaattacttacaaaaaacaggtaatgggatgatttctcctagattatgaccttttataaataaaaaagattgtgatagtctaaaatatttcatatatattttgttgattcattcatctactgatggacatttaggtcatttccaaatgtaattttttaaaattctttgtttcagtttcaagaaatacaggatcaacttacagctactataagatgtactaaggagatggaaggcgacacacaaaagtaaaatttgaagcagcacacaaaataacttgagtatttataaagcaaaagagcactgtagtatgaaaattgtatcagttatgataattagtatgtctttgtgaagccaaaaaagtttcatttgtaagctatatcgaaatacatcatttttctacattattcctaaattttgcatattatcaccaaaacacaggtagaaaatgacacagtagcccaatcgtctacttttgtgattgctaagaatttgtgtaattataccttcagaagtttgtttagaatttacatgatttaaaaaaaattacgtgtgagagtaattattttaaaatgcacattttaggcttgaagtagaacatgtgatgatgagaaaaattattaaaaaacaggatgaccaaattgagcggcttgagaaaatcctgcagcattcaagtttgatgctgcaggtgtttgagagctagatgaaggtatgttgccaaaatttatgaattaaattcaaatcattgatttctgaaataaactctaagtagtgaacggtattccc

SEQ ID NO: 451132 - DNA, 2737 bp, Homo sapiens
gtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggaaggcgacacacaaaagtaaaatttgaagcagcacacaaaataacttgagtatttataaagcaaaagagcactgtagtatgaaaattgtatcagttatgataattagtatgtctttgtgaagccaaaaaagtttcatttgtaagctatatcgaaatacatcatttttctacattattcctaaattttgcatattatcaccaaaacacaggtagaaaatgacacagtagcccaatcgtctacttttgtgattgctaagaatttgtgtaattataccttcagaagtttgtttagaatttacatgatttaaaaaaaattacgtgtgagagtaattattttaaaatgcacattttaggcttgaagtagaacatgtgatgatgagaaaaattattaaaaaacaggatgaccaaattgagcggcttgagaaaatcctgcagcattcaagtttgatgctgcaggtgtttgagagctagatgaagatatggacatttctggaattaagagccccctctacattgagcacaagacagtgacgaatccacattcttcagccagaaagtcacctctgagagccaaatgtctgactatagaaaggagagtcaaagaatgataacgacatctcaggaaaattgtgaaaataatcagcagccggatgtggataaccctttcaaatttctcctggggcctccaaccacccccactggtgttctcctgctgacagtgatttcaattttttctgggctggagctccctgatggaggggcaggccaccatctttgctgtttttgcaacttagccacttcagccttcagtctttggagtgtccaaggagaccagggggtgatgtggaccctcagcatagcacagctgctctataaagatgaggccagactgcttttttgagcactttcccaatgccattcctcctcactgggcaaaacctccaaactggggtctccagccacctcctacaggtgtgtttgggccagcaacaagttcattcatacctccctagggcaaagcttccaaagggagcggtaggctgccatctttgctgtttcacaggcttcactgatgataactccaggtactggaaaatctgaggctactagagactggagcgggccctgggcatactgcagcagccctatggaaaagtggccagactgttacctgggttcccattcctatatcttctcactaggcaagtcttgcaggcctgggcctctacctaaccccccctaccagaactgttgagccagtagcaactcagccactccctggagagagcctccaggggcaactgaaagcctctctgccactgcttctgcagtggaactgtccttgctaccctcagactgatgaaggagctaacacccttatctacaccttcaacaagctttaattgaccaaagcccatctctcatgggttctacacactccccactgctcatgacagggaacccctggattggcccccacagcacgaattctccatcctgattgctgattgcagtaaacagttgctgtattctccaggggtggtggaactctgaggagacaaacaaaagacccttggctacaaccactactaatgtcccttcctcttctgcctcaaagttaggaaagaaatataaacactgagattgccccagagctgcagtgggcagcctaggagtgccaagccatgacctacagccagcactcaagggggagagaagcacattttcagatcattgagagggaacatggctgcaactgtaaggaaacataggggagccacatgaccaagcaagagtctaccaactgaccagtaagcccaagtgccacctactggatcacatcccaaagcttcagcatcaaaaataccctactaatatactcccctctgaaaccagaaatgagaagtcagcttcaaataaagaccctgcacaaagcctcagcctggtgaaaacatccgaaaataagtctacggactgtactcaatctacactgcaattaaaggaaaacccataggtggaaatgagaagaaaccaatgcaagaactccagtaactcaaatggcctctgtgtcatatgtccttctaacaaccacaccagttctccaacaagagttcttaacctggatgaactgtctggaattacataaatataattcagaatatggataggaaaaaaaatcatcaagactcaggagaatggcaaaacccaatccaaggaaaataagaataacagtaaagtgttacaggagctgaaggataaagtagctggtataataaaaaagaacctaaccgatctgaaagcgccgaagaacacaatacaagaattccacaatgcaatcacaagtattaacagcagaaaaaaaaacctgaggaacgaatctcagaacttgaagattggttctctaaaataagatggac

SEQ ID NO: 451133 - DNA, 405 bp, Homo sapiens
gtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaagtatgtatgcaactttgcacaccaacaactgttaatctgtagctagttaactaatataaagtgttttggggtactaattttagtggatggctttcttttgtatttttatgataattaatgttattaaaattttatagtgg

SEQ ID NO: 451134 - DNA, 2041 bp, Homo sapiens
atgtgttgtcgtgcaggtagaggcttactagaagtgtgaaaacgtaggcttggattaaggcgacagcgatttctaggatagtcagtagaattagaattgtgaagatgataagtgtagagggaaggttaatggttgatattgctagggtggcgcttccaattaggtgcatgagtaggtggcctgcagtaatgttagcggttaggcgtacggccagggctattggttgaatgagtaggctgatggtttcgataataactagtatggggataaggggtgtaggtgtgccttgtggtaagaagtgggctagggcatttttaatcttagagcgaaagcctataatcactgcgcccgctcataaggggatggccatggctaggtttatagatagttgggtggttggtgtaaatgagtgaggcaggagtccgaggaggttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttagttgtggcaataaaaatgattaaggatactagtataagagatcaggttcgtcctttagtgttgtgtatggctatcatttgttttgaggttagtttgattagtcattgttgggtggtgattagtcggttgttgatgagatatttggaggtggggatcaatagagggggaaatagaatgatcagtactgcggcgggtaggcctaggattgtgggggcaatgaatgaagcgaacagattttcgttcattttggttctcagggtttgttataattttttatttttatgggctttggtgagggaggtaggtggtagtttgtgtttaatatttttagttgggtgatgaggaatagtgtaaggaatatgggggtaattatggtgggccatacggtagtatttagttggggcattt

SEQ ID NO: 451135 - DNA, 2268 bp, Homo sapiens
tattcctttgatgaccaaagagataggaagaataagagattctcattatagttatccacctcacctaacagtaatgatatataatgagaatctcttattcttcctattcctttgatgaccaaagagataaagtgaagtcatccttattattaaaatgcagcctccaaacaaatttctcaagattccttttccttccttctatccattttctgcccataatttccaagaaaaggtgggtatggaaacacatgagagaatgtgatagtgaagtcatatttacaaaactgagaacatgtccaaaatggattcttgtctcctcttcagaattagccatttaaaatattttctgtgacttcaaattgtaattcttatttgcagttttaccagtcttcatgtacagtgacgaaactgtgtagaaactaaatcatcgctttagtaagaaaggataaaaaggtgtggaagtgaatataaaatgcatctaaacatgacatttaatttgtttataaaaataagacttactaaatatagagtaattcattttgaataggaggctattgtttttatattgtgtaataactcacgtactctgaagagagcttggtcaaacaataaaatacattgttactaacttggtttcttttctgtgtactttgcaaaaattctatttttaattttgttcatatgttgaatgtgcccctaattggcatcttaaagagaatagtaagcatctattaaccaaaaaagaactctaatagtaaaggaaagggaaatattggtggtatgtacccacaaaacccccaagtgccaagttaatggaatctctgctttccctttcagatgctagaaagccactgtaatgagttcttgcagtttagcatccagtctaagctactgcattgtttaaagagcagcatcaaggacactttctccaaactggaactctcttctttgtcaaatcttgtactttaaaattctacaattctgttacattgttgtttaaatcacagactgctcagatccattttactgcagtagtttccaagtgtgtaacttggctttagtatttatcagttgccagaaagaaacaggttgtcatttggaagtttttgtggttattttttcccatttttattcttcagataaaagcagtaccccaaaatagaaaatgaaaattttcatgaaacaaagagaactcccttgttaaaaccagcttattaactctgtattctgtcaaatgcatttttttctaacaactgaccatggatgttgtgaaggtgcattttaatttaaacatggaaaagatttttttcataattacatactagaatgtaaaattataattttgccatgacttaaagagcacagttgatatcccaaaggttttgatgctaagaagctacagttattctaaatgcactaaaatgtttgaggcaaatctaccttagaggcttttttggtatggtattttttaaaatatttagattttatttaaatttcctgtgagttattctgtatttgaaaagatgttcgtgtcttcccctctgtattgaatgtttcactcattttatttttaatcaaatattttatagaaatgagttgttgggaagagtttaacatgcactatttatagtactttgccgttaacaggcaatgttctgaaactaaatttatttttgttcagtgaacataagtttagatttttaaagttggtagataatttatctccactaatatttttttaagaaactgtgaagagattaactgggaataattttatttcagattttactaatgtagtatgtagctacaacttcttgaacttcaagttaaggctagacatttactttgaaaaaattccactgggtgtttccagggctatttcattttagaaataagtgtttgccattcttctgcaaaaactggacaaggggaatactacaaaaaatactcagagataaaatcctcatttcaagttctacaaaatatttatcaaatgaatgttaatttttttttaattccctgctaaagacgttttcattagtcttagagggtatatgctttctagaacttgtttttgttaacatgtgctttgatgtaaagaacatattttgtatgcaaaacataacttgcattatggttgtacaatacactatattgtttagggattccggaaagcagtttaatgcagaaataactatatctagtatgcagttcatattgtgaatgaagctttgcttttgtaataaataaataagactttctaatgac

SEQ ID NO: 451136 - DNA, 3467 bp, Homo sapiens
tattcctttgatgaccaaagagataggaagaataagagattctcattatagttatccacctcacctaacagtaatgatatataatgagaatctcttattcttcctattcctttgatgaccaaagagataaagtgaagtcatccttattattaaaatgcagcctccaaacaaatttctcaagattccttttccttccttctatccattttctgcccataatttccaagaaaaggtgggtatggaaacacatgagagaatgtgatagtgaagtcatatttacaaaactgagaacatgtccaaaatggattcttgtctcctcttcagaattagccatttaaaatattttctgtgacttcaaattgtaattcttatttgcagttttaccagtcttcatgtacagtgacgaaactgtgtagaaactaaatcatcgctttagtaagaaaggataaaaaggtgtggaagtgaatataaaatgcatctaaacatgacatttaatttgtttataaaaataagacttactaaatatagagtaattcattttgaataggaggctattgtttttatattgtgtaataactcacgtactctgaagagagcttggtcaaacaataaaatacattgttactaacttggtttcttttctgtgtactttgcaaaaattctatttttaattttgttcatatgttgaatgtgcccctaattggcatcttaaagagaatagtaagcatctattaaccaaaaaagaactctaatagtaaaggaaagggaaatattggtggtatgtacccacaaaacccccaagtgccaagttaatggaatctctgctttccctttcagatgctagaaagccactgtaatgagttcttgcagtttagcatccagtctaagctactgcattgtttaaagagcagcatcaaggacactttctccaaactggaactctcttctttgtcaaatcttgtactttaaaattctacaattctgttacattgttgtttaaatcacagactgctcagatccattttactgcagtagtttccaagtgtgtaacttggctttagtatttatcagttgccagaaagaaacaggttgtcatttggaagtttttgtggttattttttcccatttttattcttcagataaaagcagtaccccaaaatagaaaatgaaaattttcatgaaacaaagagaactcccttgttaaaaccagcttattaactctgtattctgtcaaatgcatttttttctaacaactgaccatggatgttgtgaaggtgcattttaatttaaacatggaaaagatttttttcataattacatactagaatgtaaaattataattttgccatgacttaaagagcacagttgatatcccaaaggttttgatgctaagaagctacagttattctaaatgcactaaaatgtttgaggcaaatctaccttagaggcttttttggtatggtattttttaaaatatttagattttatttaaatttcctgtgagttattctgtatttgaaaagatgttcgtgtcttcccctctgtattgaatgtttcactcattttatttttaatcaaatattttatagaaatgagttgttgggaagagtttaacatgcactatttatagtactttgccgttaacaggcaatgttctgaaactaaatttatttttgttcagtgaacataagtttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttagatttttaaagttggtagataatttatctccactaatatttttttaagaaactgtgaagagattaactgggaataattttatttcagattttactaatgtagtatgtagctacaacttcttgaacttcaagttaaggctagacatttactttgaaaaaattccactgggtgtttccagggctatttcattttagaaataagtgtttgccattcttctgcaaaaactggacaaggggaatactacaaaaaatactcagagataaaatcctcatttcaagttctacaaaatatttatcaaatgaatgttaatttttttttaattccctgctaaagacgttttcattagtcttagagggtatatgctttctagaacttgtttttgttaacatgtgctttgatgtaaagaacatattttgtatgcaaaacataacttgcattatggttgtacaatacactatattgtttagggattccggaaagcagtttaatgcagaaataactatatctagtatgcagttcatattgtgaatgaagctttgcttttgtaataaataaataagactttctaatgac

SEQ ID NO: 451137 - DNA, 2266 bp, Homo sapiens
tattcctttgatgaccaaagagataggaagaataagagattctcattatagttatccacctcacctaacagtaatgatatataatgagaatctcttattcttcctattcctttgatgaccaaagagataaagtgaagtcatccttattattaaaatgcagcctccaaacaaatttctcaagattccttttccttccttctatccattttctgcccataatttccaagaaaaggtgggtatggaaacacatgagagaatgtgatagtgaagtcatatttacaaaactgagaacatgtccaaaatggattcttgtctcctcttcagaattagccatttaaaatattttctgtgacttcaaattgtaattcttatttgcagttttaccagtcttcatgtacagtgacgaaactgtgtagaaactaaatcatcgctttagtaagaaaggataaaaaggtgtggaagtgaatataaaatgcatctaaacatgacatttaatttgtttataaaaataagacttactaaatatagagtaattcattttgaataggaggctattgtttttatattgtgtaataactcacgtactctgaagagagcttggtcaaacaataaaatacattgttactaacttggtttcttttctgtgtactttgcaaaaattctatttttaattttgttcatatgttgaatgtgcccctaattggcatcttaaagagaatagtaagcatctattaaccaaaaaagaactctaatagtaaaggaaagggaaatattggtggtatgtacccacaaaacccccaagtgccaagttaatggaatctctgctttccctttcagatgctagaaagccactgtaatgagttcttgcagtttagcatccagtctaagctactgcattgtttaaagagcagcatcaaggacactttctccaaactggaactctcttctttgtcaaatcttgtactttaaaattctacaattctgttacattgttgtttaaatcacagactgctcagatccattttactgcagtagtttccaagtgtgtaacttggctttagtatttatcagttgccagaaagaaacaggttgtcatttggaagtttttgtggttattttttcccatttttattcttcagataaaagcagtaccccaaaatagaaaatgaaaattttcatgaaacaaagagaactcccttgttaaaaccagcttattaactctgtattctgtcaaatgcatttttttctaacaactgaccatggatgttgtgaaggtgcattttaatttaaacatggaaaagatttttttcataattacatactagaatgtaaaattataattttgccatgacttaaagagcacagttgatatcccaaaggttttgatgctaagaagctacagttattctaaatgcactaaaatgtttgaggcaaatctaccttagaggcttttttggtatggtattttttaaaatatttagattttatttaaatttcctgtgagttattctgtatttgaaaagatgttcgtgtcttcccctctgtattgaatgtttcactcattttatttttaatcaaatattttatagaaatgagttgttgggaagagtttaacatgcactatttatagtactttgccgttaacaggcaatgttctgaaactaaatttatttttgttcagtgaacataagtttagatttttaaagttggtagataatttatctccactaatatttttttaagaaactgtgaagagattaactgggaataattttatttcagattttactaatgtagtatgtagctacaacttcttgaacttcaagttaaggctagacatttactttgaaaaaattccactgggtgtttccagggctatttcattttagaaataagtgtttgccattcttctgcaaaaactggacaaggggaatactacaaaaaatactcagagataaaatcctcatttcaagttctacaaaatatttatcaaatgaatgttaatttttttttaattccctgctaaagacgttttcattagtcttagagggtatatgctttctagaacttgtttttgttaacatgtgctttgatgtaaagaacatattttgtatgcaaaacataacttgcattatggttgtacaatacactatattgtttagggattccggaaagcagtttaatgcagaaataactacccacttcagaaagccttgagacaaacattgtagcacatgagaccttgtcttaaaaaaataaaaaattt

SEQ ID NO: 451138 - DNA, 3539 bp, Homo sapiens
  misc_feature (2)..(4): n is a, c, g, or t
  misc_feature (8)..(8): n is a, c, g, or t
  misc_feature (13)..(13): n is a, c, g, or t
annntccnctttnagttcctggtccagaactttacacagaaaaggtgctcaaaggatatttgtttaatgaatgtggtatgctgacatttaaacaggacaaaacttgtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttcgcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaaaagtggaattgttcat

SEQ ID NO: 451139 - DNA, 4554 bp, Homo sapiens
taaggtatttataccaattgacgtttaaaacgtctctaacgtgccttaaattgcgtttaaacgatactatgagctaatacactctgacaaacttcttgtcagcacgttcaaactcttcaacataatcaattgccacaacataattatacgtgtcaatcttagcaactgacatattgccgtcaaattcttgcaactctgcaatcaattctgctactgtcatcattctacctccaaatattcaaattttacgcccttgtgagacttcagtcttcccttaagtacgttgacaattgtgcttggcagaatacctcgctccttagcgtaaatggtagcactgtcaaatacttcatacgtaccgtcttcatggattgctttaataggtttttgattagttggctttaattgtttgtttgttttaacaaaattcttctctgcgtaattgttaatctcatctagtctgttgctgtctttaaacgcgttataaatcagagttttaactgattttgtttttgatttaccttttttagacagtgccactactagccaaccagacccactacgacccggctttaaaattcttccgtaacgaacactctttacacgtccatgtgtacttacttgataatatccttcgtagccttcgatatctttccatacttcaatcatttattttctcatttctatttattaactaacttatgttctgctttgttgagtacaacgtgccagttatctaagttcatgttagttttgtatccgtctattggctctaaaaactcccgatactccaacttgcggacaaacgtttcaaacatcaacttcttaactaacacattcaatcgtcgatcgcttttcgacgtttttccaattgtgacgtaaacgtttcctttaattcttacgcatgtttttaattctatatcgacaccgtgtgatactttctttacgtggtcctttatttgatattaaaatatattccgtcgcagtctccacggcgcaggcccacggtagcgcagccgctctgaggctggagtgcagtggtgtgatctcggctctctgcaacttccacatcccgggttcaagcgattctactgcctcagcctcccgagtagttgggactacagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttcgcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaaaagtggaattgttcat

SEQ ID NO: 451140 - DNA, 3301 bp, Homo sapiens
gcggcagcgctcgccattgccgctggtggcaggaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttcgcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaaaagtggaattgttcat

SEQ ID NO: 451141 - DNA, 3214 bp, Homo sapiens
gcggcagcgctcgccattgccgctggtggcaggaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttcgcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctatctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaaaagtggaattgttcat

SEQ ID NO: 451142 - DNA, 1593 bp, Homo sapiens
gcggcagcgctcgccattgccgctggtggcaggaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttcgcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacaggtggtggcaagagtgtgggaataagtgaggatcgcaaatctgtccctgcagatatgggtggaggccccttaaagagaaatgtgtctctgtttgccacagttggcagttggaacttaacactcttggcccatacgatattgtagtttggcctataataggtcagtccttaccaagaaaaattaaacttctttccttcaggtgtgcttaggaaaggtgatgtgaaatggaatcctccagtaaaaggtagtttccaaaactca

SEQ ID NO: 451143 - DNA, 360 bp, Homo sapiens
gtagcaattattagaaaaattacttgtaaaattgtacttttgtggctttgtttttttactatcttgtcctttctgcctcaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacaggtggtggcaagagtgtgggaataagtgaggatcgcaaatctgtccctgcagatatgggtggaggccccttaaagagaaatgtgtctctgtttgccacagttggcagttggaacttaacact

SEQ ID NO: 451144 - DNA, 3369 bp, Homo sapiens
taaggtatttataccaattgacgtttaaaacgtctctaacgtgccttaaattgcgtttaaacgatactatgagctaatacactctgacaaacttcttgtcagcacgttcaaactcttcaacataatcaattgccacaacataattatacgtgtcaatcttagcaactgacatattgccgtcaaattcttgcaactctgcaatcaattctgctactgtcatcattctacctccaaatattcaaattttacgcccttgtgagacttcagtcttcccttaagtacgttgacaattgtgcttggcagaatacctcgctccttagcgtaaatggtagcactgtcaaatacttcatacgtaccgtcttcatggattgctttaataggtttttgattagttggctttaattgtttgtttgttttaacaaaattcttctctgcgtaattgttaatctcatctagtctgttgctgtctttaaacgcgttataaatcagagttttaactgattttgtttttgatttaccttttttagacagtgccactactagccaaccagacccactacgacccggctttaaaattcttccgtaacgaacactctttacacgtccatgtgtacttacttgataatatccttcgtagccttcgatatctttccatacttcaatcatttattttctcatttctatttattaactaacttatgttctgctttgttgagtacaacgtgccagttatctaagttcatgttagttttgtatccgtctattggctctaaaaactcccgatactccaacttgcggacaaacgtttcaaacatcaacttcttaactaacacattcaatcgtcgatcgcttttcgacgtttttccaattgtgacgtaaacgtttcctttaattcttacgcatgtttttaattctatatcgacaccgtgtgatactttctttacgtggtcctttatttgatattaaaatatattccgtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttcgcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggtttt

SEQ ID NO: 451145 - DNA, 3534 bp, Homo sapiens
gcggcagcgctcgccattgccgctggtggcaggaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttcgcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaaaagtggaattgttcat

SEQ ID NO: 451146 - DNA, 3481 bp, Homo sapiens
gcggcagcgctcgccattgccgctggtggcaggaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttcgcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaagtgtgtgtatgtgtgagtgtgaatatatgtatatgtgtacatatggacatacacatttacatatatataaagtatatatatacatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaaaagtggaattgttcat

SEQ ID NO: 451147 - DNA, 1862 bp, Homo sapiens
gcggcagcgctcgccattgccgctggtggcaggaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttcgcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggttactgatgtgattgctcaagcccaattctgggactgggaaaacggcacatttgccatatcgattctgcagccagattgaatcagatctaaaagccacacccaggccttggtcctagcagccactcgagaatggctcacgcagatacagaaggtggtcatggcactaacgagactacatgggcgcctcctgtcaacgcctgtatcagggggcaccaaaagtgcgtgcctgacgtgccagaaactggcagaatggcaagctccccaacatcatcggtgggttccccctgatcgggtgctaagctatcctttaacccggatatactggtcgcccaatacatcaagatgtttgtactggatcgcacgataaagtacatgcaacgccgcgcttcaacgcacaactag

SEQ ID NO: 451148 - DNA, 650 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggt

SEQ ID NO: 451149 - DNA, 733 bp, Homo sapiens
  misc_feature (662)..(662): n is a, c, g, or t
  misc_feature (733)..(733): n is a, c, g, or t
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggtaaaaaaaaaaantttcacaatcatggccgccgtttcgtctgaatcggaaacacctgtgggtacccatctcggctttggggtcn

SEQ ID NO: 451150 - DNA, 746 bp, Homo sapiens
  misc_feature (667)..(667): n is a, c, g, or t
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggtccaaaaaaaaaatctcntcaattggcgcccgaatttgagcttacttggcaattctgcctaatgggagccgatttccattcaatgcccggcgtttct

SEQ ID NO: 451151 - DNA, 748 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggtatcttctcaccacctatctcttctcccctcttccctctctccacaacaaaccctgtgggcccccttcgcccaatccccttttgacctcgggcaagtca

SEQ ID NO: 451152 - DNA, 765 bp, Homo sapiens
  misc_feature (8)..(8): n is a, c, g, or t
  misc_feature (561)..(561): n is a, c, g, or t
  misc_feature (563)..(563): n is a, c, g, or t
  misc_feature (572)..(572): n is a, c, g, or t
ccgcgcgnactacggctgccgagaagaccaacagaaggggaccaacggaagagcacgacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggtcananaaaaaaaanagaacaataaacacacagaacacaaaaaccactcaaaaacaacgcaaaacaaaacaccgaggacacctatattgggggggaggacacaaaagagcaacagaggacaaagcgaacaacgtatcacacacccacgctggagaaagagaggaaaacggagggccccaaaagggagcaaacccaaacggggacctat

SEQ ID NO: 451153 - DNA, 2017 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgcaaaaaaaataaaaagatacgaacacacacacaaag

SEQ ID NO: 451154 - DNA, 1939 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgc

SEQ ID NO: 451155 - DNA, 1948 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaagtccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgc

SEQ ID NO: 451156 - DNA, 664 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaagttctgttttttgtgggggggggggggggttttttttttgttttttttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggt

SEQ ID NO: 451157 - DNA, 325 bp, Homo sapiens
gcagattgcagcggacatcccagaagtggttgtttcccttgcatgggacgaaagcttggctccaaagcatcacaggctcaaggaaaaacatggcctgctattggccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgc

SEQ ID NO: 451158 - DNA, 448 bp, Homo sapiens
tattgctccatttctgagttggtctcactttccaccccactgacggcgcgctgcgtgaggggcggggcatagagggaggggaggggctatgcgaaagaaggcggggagagtggggtggggccgctccttggaacggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtaagggacggctgtgagggccggaggccgcggccttcccgggcggcgccgggccaagccctgctggacagaggcgcgcccaccgcggccg

SEQ ID NO: 451159 - DNA, 359 bp, Homo sapiens
agaaaataagtttaactcagtaggagagtggaaagggatttgtagttgataggtctatatgtcatttttacttgtgctcatataatgaaaaacatgttgatgatttttccttcttcaacagttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggt

SEQ ID NO: 451160 - DNA, 558 bp, Homo sapiens
  misc_feature (8)..(8): n is a, c, g, or t
ccgcgcgnactacggctgccgagaagaccaacagaaggggaccaacggaagagcacgacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggt

SEQ ID NO: 451161 - DNA, 1890 bp, Homo sapiens
  misc_feature (8)..(8): n is a, c, g, or t
ccgcgcgnactacggctgccgagaagaccaacagaaggggaccaacggaagagcacgacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgc

SEQ ID NO: 451162 - DNA, 857 bp, Homo sapiens
  misc_feature (653)..(653): n is a, c, g, or t
  misc_feature (655)..(655): n is a, c, g, or t
  misc_feature (664)..(664): n is a, c, g, or t
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggtcananaaaaaaaanagaacaataaacacacagaacacaaaaaccactcaaaaacaacgcaaaacaaaacaccgaggacacctatattgggggggaggacacaaaagagcaacagaggacaaagcgaacaacgtatcacacacccacgctggagaaagagaggaaaacggagggccccaaaagggagcaaacccaaacggggacctat

SEQ ID NO: 451163 - DNA, 1928 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggattagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgc

SEQ ID NO: 451164 - DNA, 1982 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgc

SEQ ID NO: 451165 - DNA, 829 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggtcgaagccctttttttacttggcattcttttttgagggattttttgttggattaaagtggaggcgcgagtttttattaaacaaatattcaaccccttgatacatgagataatattattccatcattacctggttttcctccttgtcctatgcaatttagaatgtacaagttttcttgccc

SEQ ID NO: 451166 - DNA, 815 bp, Homo sapiens
ggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggatccttggggaagaagatgtttgagacttaagagttttaattttggcacaacggactgttggttacaccaataggggg

SEQ ID NO: 451167 - DNA, 623 bp, Homo sapiens
agtggcagcatgatgtagtgaaaagagcctggactttggagacatgccgagtggggtgacagctttctcacccgctggctctgtgaccacagcccagccatgtcctgggtgcttcagctgccaaatgcaaatatctgccgtgcagagtcacgttgcatattgagtgagctattttaagcatagagtatggcatgtagtaggttctcagtatagggtaatcattattgttattattcctgtaatattttcaaaatgtttcttttagaatattttgattgatgcctgtgttttagactccgactcagggctcctccaacaggtatgttttaaaaccatgctttgtgtcggtggttatgacaattagtgatttttatattgattacaatttaaaatgaaagctttgggtatattgggttaaataaaatatgttattcagcctaattttatctatgtctttcccccttacgtatggagctactggaaaattttaaattacatattgcttgcgttatatttccgttgggcagcactaaaagacaaaaactgaattttactttaacccgaaagggaaacaaaaccctaaagtaagtctgaagaaattactgagtttttgttagatgttt

SEQ ID NO: 451168 - DNA, 2420 bp, Homo sapiens
  misc_feature (1929)..(1929): n is a, c, g, or t
acttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttatnaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatca

SEQ ID NO: 451169 - DNA, 2340 bp, Homo sapiens
  misc_feature (1849)..(1849): n is a, c, g, or t
acttggcggcgccggacgttgggctgcgcaggatttgagacgctcccctgaccaccacttgctctgcgctgaggtgctgggacagccatggtttcagacgttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttatnaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatca

SEQ ID NO: 451170 - DNA, 2256 bp, Homo sapiens
  misc_feature (1765)..(1765): n is a, c, g, or t
acttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaaggtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttatnaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatca

SEQ ID NO: 451171 - DNA, 2291 bp, Homo sapiens
  misc_feature (1800)..(1800): n is a, c, g, or t
acttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggcttgtgacatcacgggaggactgtacctgaaggtgcctcagatgccttctcttctgcagtatttgctgtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttatnaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatca

SEQ ID NO: 451172 - DNA, 840 bp, Homo sapiens
acttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggcttgtgacatcacgggaggactgtacctgaaggtgcctcagatgccttctcttctgcagtatttgctgtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgagagagggaagggggtaccgagctaaag

SEQ ID NO: 451173 - DNA, 580 bp, Homo sapiens
acttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctgtatccttggtgtctgaatcatttagaaggtgtcttctgtaataaacatatcttaacttgtgacat

SEQ ID NO: 451174 - DNA, 1910 bp, Homo sapiens
acttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggcagaggttgcagtgagccaagatagcgcctctgtactccagcctgggtgacagagcgagactctgtatca

SEQ ID NO: 451175 - DNA, 1493 bp, Homo sapiens
acttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgt

SEQ ID NO: 451176 - DNA, 2397 bp, Homo sapiens
  misc_feature (1906)..(1906): n is a, c, g, or t
acttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcccaaggcattgctcatgagaacctcattcctctggaaaccctagtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttatnaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatca

SEQ ID NO: 451177 - DNA, 2232 bp, Homo sapiens
  misc_feature (1741)..(1741): n is a, c, g, or t
ggaatttaggatgctccagctccgccgccagctccagaccttgctccgcctttcctgaggttactcgtaccttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggcttgtgacatcacgggaggactgtacctgaaggtgcctcagatgccttctcttctgcagtatttgctgtgggtgtttcttcccgatcaagatcagagatctcagttaatcctcccacccccggttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttatnaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatca

SEQ ID NO: 451178 - DNA, 746 bp, Homo sapiens
  misc_feature (716)..(716): n is a, c, g, or t
  misc_feature (721)..(721): n is a, c, g, or t
  misc_feature (726)..(726): n is a, c, g, or t
acttggcggcgccggacgttgggctgcgcaggatttgagacgctcccctgaccaccacttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggcttgtgacatcacgggaggactgtacctgaaggtgcctcagatgccttctcttctgcagtatttgctgtgggtgtttcttcccgaccaagatcagagatctcgatgacagaagcaagcagccctgtagtcaacatgaaccgngggtnggagnattaacgggtacgagctagg

SEQ ID NO: 451179 - DNA, 386 bp, Homo sapiens
aagattgtgccactgcactctagcctgggtgacagaactagactcggtctcaaaaaaaataaaataagggaataaatgcagaacgaattttaatacaaaaggccttatctccaattgatggctctttttgccctgttaatgattgaatataattaaggatccatgttaacttcgacttttttataatcccatgtatccatcatttttctaatcccataattgattttagaatactgtcttctatggacctaaaatctttttctgtcagaaatttcagtgagaaggtatgtacattctctcataggacatgtgctaaaattttgatgatgaagattaatatggcctttttacaagattgcgtgttggggatcctgctagagtcagct

SEQ ID NO: 451180 - DNA, 2153 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaagggcggccgcccttttctagtgttcgttaacttcattaaaatactgagttttatttcacatgtatatagtgggtctccccaccaggtatccatgtctgaccaccgctactactatgtcctatcataacattccatacatacttaaaacgcaagcaaaggggggcgtcccatctttaaaaactaagacgaggcattgtgggaccaacacatatctgggcaactagacaccgtgggaccaaacatttatcaaacacggtagggaaagttctcactctggcattatacaaaggacagccagatatcaacgggttacagacaactgaactaagacggaaaaattttacaccaaattgtttacactattctcttacagagacttcctccatgtgccagagatctggaatagcctctggacagtcatccggaagcaattcttccacattaatgcggacattgggcttccacattgggaagagaaccacgcttatttctatactctgcaagcatttcggctaaaggtattctacagaacaggtcctttggagtctaggaactgattccgggttttcgaagaatctggcctttgacctgatgtgcatacagaccagagatctccacggactgcacatgggac

SEQ ID NO: 451181 - DNA, 1543 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtatcaattggcgttgtgtggtttttctggttgtcggtgtggttctggcgggccggtgggggt

SEQ ID NO: 451182 - DNA, 1377 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttagagatacgggatcctctgacagcc

SEQ ID NO: 451183 - DNA, 1170 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggttttacttgtggggaattaactccacacccataagggttcatttttgggcccaaatttttttccggggggggctttccccacacatttttttttaaaaccccccaaaaaaacttttttttttttttcacaacacaacccccccccgccatgcccctgtcctgcgcggcgcggcgggccactcctcacgcagccggccgagcgcctactcttctctcctccacacaaacgccccccacccccaccaccccccatcattagtccttcttcttcccaacaccacacacccacaccacaccatccaccaccccaccctccttctaacag

SEQ ID NO: 451184 - DNA, 1915 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatttgcacactgagatattaggaagaattggtttttcctaatatctcatttcaaattactgatacaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451185 - DNA, 920 bp, Homo sapiens
  misc_feature (743)..(743): n is a, c, g, or t
  misc_feature (797)..(797): n is a, c, g, or t
  misc_feature (805)..(805): n is a, c, g, or t
  misc_feature (810)..(810): n is a, c, g, or t
  misc_feature (814)..(814): n is a, c, g, or t
  misc_feature (820)..(820): n is a, c, g, or t
  misc_feature (824)..(824): n is a, c, g, or t
  misc_feature (833)..(833): n is a, c, g, or t
  misc_feature (920)..(920): n is a, c, g, or t
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaccatttttttaattagtcacttttttaagaacttaatgtnccttgggaccggtttggggcaaagtggggggggcacacataaatggtgtggggngtccccantgggntgtntgggcnattnagggggcantagaggagaaggggttccaaaagcgtagaggaggggggggatctgagtggtgagtgtcaaaacatgagcgtgatatggagaagtttn

SEQ ID NO: 451186 - DNA, 1829 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451187 - DNA, 2018 bp, Homo sapiens
gcttttttggcctgctgccattccagtaggatgtgacttgcttctcctggccatggttgtgaggcctccccagctatgtggaactgtaagtccggtaaacctctttcttttataaattgcccagtctcgggtatatcttcattagcagcgtgaaaacggacaaatacagcttcagtttcccctcactccactccccattaggggatagttttgtccagattaaagaaaaacctatggtttatggtggtgctaggggaaatgaagaggaaagtcttgcctctccattttcttccgttcatgaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451188 - DNA, 2715 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttgatcattagttcctgttgtttaaaactcatgtgaacctttaagatgggctgaagaaaagtggatctgtactacaaaatgaggaaagggctgccagcttaaagttgctgtttttgaagattctacaacagatggctttatgaccaaccataagcagatcttaagtatctagtgaagaatttaactgctaacaaggaagaatttggtttgatttaaaagtaatatcttcaagcacggggtttcaccatattggccaggctggtttcgaactgctgacctggtggtccgcctgcctcggcctcccagagtgctgggattacaggcgtaagccaccacgcctggccaagaaaatcaagatttacctggtttatgtgttgaccagctatacacagagaattctagatttttttctaaaaattattatcaaacccccaatttcaccagtagaaaaagagatcttaagatttctgtgtttttttttccagcataactcagttacttatggctgggagaaaatatgtagggagataatctaatacctaattcgaaggaagaaaatatctaattctaagtcttgagttcttctcatcagaccatagcaggatttaacatttaacatttttcagaagcttctaatagacttcattcagttttttgtccacagcagtggcatttaaattactgtactttaagacatggaattgctggaggcttggaaacttgagtgcaatttccctagtacgacctccaaggagaatagagcaaaacagtggtaggaaaaactctcaaaattttacccaattgtatgttttctacattgtcagtatctagttttatatagttaatatgtacttctaaaatttctgacatgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451189 - DNA, 1802 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451190 - DNA, 2080 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttagacagtgtcttgctctattgctcaggctgcagtgcagtggcatgatcatagctcactgcatcctcgacctcctgggctcaagcggtcctcttgcttcagcctcctgaatagcagagactacagcagtggcatttaaattactgtactttaagacatggaattgctggaggcttggaaacttgagtgcaatttccctagtacgacctccaaggagaatagagcaaaacagtgtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451191 - DNA, 1956 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttcagtggcatttaaattactgtactttaagacatggaattgctggaggcttggaaacttgagtgcaatttccctagtacgacctccaaggagaatagagcaaaacagtgtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451192 - DNA, 1877 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggctgcagtgcagtggcatgatcatagctcactgcatcctcgacctcctgggctcaagcggtcctcttgcttcagcctcctgaatagcagagactacagtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451193 - DNA, 1784 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451194 - DNA, 1436 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttacctttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451195 - DNA, 728 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaagaaattttatgacttttggaagaacattgaatttggccattaaa

SEQ ID NO: 451196 - DNA, 436 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttacccatgtggaaaaaaatttgggggtaaaaaaaggaactcttggggggggggcgc

SEQ ID NO: 451197 - DNA, 736 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttgatcattagttcctgttgtttaaaactcatgtgaacctttaagatgggctgaagaaaagtggatctgtactacaaaatgaggaaagggctgccagcttaaagttgctgtttttgaagattctacaacagatggctttatgaccaaccataagcagatcttaagtatctagtgaagaatttaactgctaacaaggaagaatttggtttgatttaaaagtaatatcttcaagcctgggcaacatggagaaaccccgtctctactaaaaatggaaaaattagctaggtgtggttgtgtgtgcctgtagtcccagctactcaggaagctgaggatcgcttgagcccaggacgcaggttgcagtgagctgagattgcaccactacacccccaacctgggccacagagtgagacactgtctcaaaaatacataccttcagcaaatcaagattttttttttttt

SEQ ID NO: 451198 - DNA, 760 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttagagacggggttttcaccatgttgaccaggatggtctccatctctttacctcatgatccacccaccttggcctcctgaatagcagagactacaggtgtgcaccaccacactcagctaatttttaaatttttttgtcaagacagggtctcattatattgcccaggttgatctggaactcctggactcaagccatctttctgccttagcctcccaaaccactgggattatgggtgtgaaccactaagtacttcttaaatcttgacattccacacagaaaaattttaattgtgattgtcacagagtggttaggtatacttgctgaagaaaaacccctatgtcctgtcttaaaaataggggaataggccgggcgcggtggctcgtgctggtaatcccagcattctgggaggctgaggtgggcggatcatgaggtcaggagttcgagaccagcctgaccaacacagtgaaaccccgtctctacta

SEQ ID NO: 451199 - DNA, 279 bp, Homo sapiens
atgatgaggttgaacttcaagttatttaagttgttgacttttattataggatcattagttcctgttgtttaaaactcatgtgaacctttaagatgggctgaagaaaagtggatctgtactacaaaatgaggaaagggctgccagcttaaagttgctgtttttgaagattctacaacagatggctttatgaccaaccataagcagatcttaagtatctagtgaagaatttaactgctaacaaggaagaatttggtttgatttaaaagtaatatcttcaag

SEQ ID NO: 451200 - DNA, 431 bp, Homo sapiens
caccttataagtctcacagacattccctgaatgtggatgtgttttgagaatgttcagtacatctcttcaaactggctgcaaataaaatatccaactttttaagtcttaaataaatggtagcaaaggaatgaactaaaatagctgattttttttttaacttcatttcggtttagtttatagtaaaaatgcctttagatgtttgggggtatttattctaaaaggatccttttcagcctacctgaagactaaattatttataagaaatgtcatttgtcttcactgtttctaaatatgtatttttgtttcaggcacgtgtggttctcaaatataggcattctgatgggaacttgtgtgttaaagtaacagatgatttagtttgtaagtatacatttttatttgttacatactttcagatttgtttgagttaatta

SEQ ID NO: 451201 - DNA, 1848 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451202 - DNA, 1456 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattataacactaccccatggggtaaaaagtttcc

SEQ ID NO: 451203 - DNA, 1795 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatatatgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451204 - DNA, 1805 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttcttttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451205 - DNA, 1972 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttagacagtgtcttgctctattgctcaggctgcagtgcagtggcatgatcatagctcactgcatcctcgacctcctgggctcaagcggtcctcttgcttcagcctcctgaatagcagagactacagtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451206 - DNA, 2821 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttgatcattagttcctgttgtttaaaactcatgtgaacctttaagatgggctgaagaaaagtggatctgtactacaaaatgaggaaagggctgccagcttaaagttgctgtttttgaagattctacaacagatggctttatgaccaaccataagcagatcttaagtatctagtgaagaatttaactgctaacaaggaagaatttggtttgatttaaaagtaatatcttcaagcctgggcaacatggagaaaccccgtctctactaaaaatggaaaaattatagctgggattacaggcacacgccaccacgcccagctaatttttgtatttttagtagagacggggtttcaccatattggccaggctggtttcgaactgctgacctggtggtccgcctgcctcggcctcccagagtgctgggattacaggcgtaagccaccacgcctggccaagaaaatcaagatttacctggtttatgtgttgaccagctatacacagagaattctagatttttttctaaaaattattatcaaacccccaatttcaccagtagaaaaagagatcttaagatttctgtgtttttttttccagcataactcagttacttatggctgggagaaaatatgtagggagataatctaatacctaattcgaaggaagaaaatatctaattctaagtcttgagttcttctcatcagaccatagcaggatttaacatttaacatttttcagaagcttctaatagacttcattcagttttttgtccacagcagtggcatttaaattactgtactttaagacatggaattgctggaggcttggaaacttgagtgcaatttccctagtacgacctccaaggagaatagagcaaaacagtggtaggaaaaactctcaaaattttacccaattgtatgttttctacattgtcagtatctagttttatatagttaatatgtacttctaaaatttctgacatgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451207 - DNA, 1787 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagccatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451208 - DNA, 1945 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttagagacggggttttcaccatgttgaccaggatggtctccatctctttacctcatgatccacccaccttggcctctgaaagtgctgagattacagggtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451209 - DNA, 1953 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttagacagtgtcttgctctattgctcaggctgcagtgcagtggcatgatcatagctcactgcatcctcgacctcctgggctcaagcggtcctcttgcttcagcctcctgaatagcagagactacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgcaaattaaaacaacgagggaggagcaaatagccaaccaccatcggtagtaaaacggggcacaacgagagacgaaacaaaaaaaagagagccgcaagtaaaaaaagcgaaaggaaacaacacacgcgagtgtagacggagacccaccacgggagagaaagggaacactaaacgaaagccgcaggacaaaaaacatgagcgtggaacacgtcaccgcgaagacgccgaataaatca

SEQ ID NO: 451210 - DNA, 694 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgaaacaggaatggtctctgcattggtcttgtggatattgtctgtttt

SEQ ID NO: 451211 - DNA, 439 bp, Homo sapiens
  misc_feature (392)..(392): n is a, c, g, or t
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccgtggaaanggggggggggggggcttcctttttttttttgggggggggaaaaaaaa

SEQ ID NO: 451212 - DNA, 789 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttagacagtgtcttgctctattgctcaggctgcagtgcagtggcatgatcatagctcactgcatcctcgacctcctgggctcaagcggtcctcttgcttcagcctcctgaatagcagagactacaggtgtgcaccaccacactcagctaatttttaaatttttttgtcaagacagggtctcattatattgcccaggttgatctggaactcctggactcaagccatctttctgccttagcctcccaaaccactgggattatgggtgtgaaccactaagtacttcttaaatcttgacattccacacagaaaaattttaattgtgattgtcacagagtggttaggtatacttgctgaagaaaaacccctatgtcctgtcttaaaaataggggaataggccgggcgcggtggctcgtgctggtaatcccagcattctgggaggctgaggtgggcggatcatgaggtcaggagttcgagaccagcctgaccaacacagtgaaaccccgtctctacta

SEQ ID NO: 451213 - DNA, 353 bp, Homo sapiens
aagcagtggtatcaacgcagagtgcccattacggcgggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagttctatgctcatttggtcattcatgcagaccatagttcaggagtatcacagaagtttgcaggtatccaacaagtct

SEQ ID NO: 451214 - DNA, 371 bp, Homo sapiens
atctcgttttccttcctgtcccctgtaggccttcagccacttcacttttgagcgttccggccatcagctgatagtggtggacatccagggagttggggatctctacactgacccacagatccacacggagacgggcactgactttggagacggcaacctaggtacgtggggaaagccagcctgtttctgcagaaaccacgctccctgctaaaacctctgagttcttcgtacagccaaggaaacaggctgagacactgtacgcgctttttcaagatcatggagatgggagactggatgtctgatgcctcccagcttggcacgttttatacctgccctggccatatgtatgaggcccaccactgcctgtcccc

SEQ ID NO: 451215 - DNA, 5670 bp, Homo sapiens
  misc_feature (2983)..(2983): n is a, c, g, or t
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttgtcacgagatataagaaagtgctttttgccttgaatggacaattttagggctgtgctcactagtcttttcaggctggactgaaatgtcgggcccatggagccctgtgttttgtgcatcgggntgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaatttgtgttccccagggcaccaaaacacagtgcttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccacctcagcctcccaaagcattggggttacaggcgtgagccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcagactcaaa

SEQ ID NO: 451216 - DNA, 5335 bp, Homo sapiens
  misc_feature (2983)..(2983): n is a, c, g, or t
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttgtcacgagatataagaaagtgctttttgccttgaatggacaattttagggctgtgctcactagtcttttcaggctggactgaaatgtcgggcccatggagccctgtgttttgtgcatcgggntgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaatttgtgttccccagggcaccaaaacacagtgcttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcagactcaaa

SEQ ID NO: 451217 - DNA, 5196 bp, Homo sapiens
  misc_feature (2983)..(2983): n is a, c, g, or t
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttgtcacgagatataagaaagtgctttttgccttgaatggacaattttagggctgtgctcactagtcttttcaggctggactgaaatgtcgggcccatggagccctgtgttttgtgcatcgggntgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaatttgtgttccccagggcaccaaaacacagtgcttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcagactcaaa

SEQ ID NO: 451218 - DNA, 4633 bp, Homo sapiens
  misc_feature (2983)..(2983): n is a, c, g, or t
  misc_feature (4610)..(4610): n is a, c, g, or t
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttgtcacgagatataagaaagtgctttttgccttgaatggacaattttagggctgtgctcactagtcttttcaggctggactgaaatgtcgggcccatggagccctgtgttttgtgcatcgggntgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattccgcaaagaccncaaaagggtatctctctagactc

SEQ ID NO: 451219 - DNA, 2565 bp, Homo sapiens
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagactccatctcaaaaaaaagaagaa

SEQ ID NO: 451220 - DNA, 2396 bp, Homo sapiens
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaaggccgttccgcctcccctcgttcacctcatagagcagtcatggcttttcctcatcactcccctctacagtgcctggtagtcaagtgttgcatcgaacaacccggacctcttgttaagacttgtcctgtagctcgatatttcagatgtgctagtgagggcaatcaggtgaaggctgtctgcccagacaaataagtaatttatataagtgaatctttttcataaat

SEQ ID NO: 451221 - DNA, 1144 bp, Homo sapiens
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggtgaggccgagctcacctccaccctctgcccaccacagcccttggggtgagatcctggccaggctcagcccctaaagaggaaggtccctgtgggcttggagtctcacccccagagaagcctcttggagcattcagaaggagacccgtcaccccatgacagcttctgtcacctaaggtggccacaggacctgcagcccaaggtccctgcccaactgaagaggcctttttcctttgtcttttcctctatataactccttgaagagaaagcccctcagcatgggcagaggcgtggccagtgcctgcacagacctcagcctg

SEQ ID NO: 451222 - DNA, 536 bp, Homo sapiens
aggggttgcttggttagagggaacaacaggaagagccctttaattcccagagggtgtgtgcgtgacatgagtatccctattaatgtccctagcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccgtgagtgacggttcggtccctagtcactgtgattggaggggacaggtggagcagagctaaaccagctttcatttatgttagaaaaatcagacatgctaatcgaaaaggttcatggccccagtggttttataggtgagtttcattgagtgaactttcaaaacagatcatccaaatgctataaaaacaacccctattgtaggaaacaaagtaacttttatcagtgtgttttatgaaaccagcaa

SEQ ID NO: 451223 - DNA, 5630 bp, Homo sapiens
  misc_feature (2983)..(2983): n is a, c, g, or t
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttgtcacgagatataagaaagtgctttttgccttgaatggacaattttagggctgtgctcactagtcttttcaggctggactgaaatgtcgggcccatggagccctgtgttttgtgcatcgggntgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaatttgtgttccccagggcaccaaaacacagtgcttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcagactcaaa

SEQ ID NO: 451224 - DNA, 5560 bp, Homo sapiens
  misc_feature (2983)..(2983): n is a, c, g, or t
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttgtcacgagatataagaaagtgctttttgccttgaatggacaattttagggctgtgctcactagtcttttcaggctggactgaaatgtcgggcccatggagccctgtgttttgtgcatcgggntgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaatttgtgttccccagggcaccaaaacacagtgcttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccaccttcaaaacctagtttgggctgggtgcagtggctcacgccactttgggaggctgaggtgggcggatcacctgaagtcagctactcgggaggctgaggcaggagaatcgcttgaacccaggaggcagaggttgcagtgagccgagattgcgtcactgcactccagcctgggcgacagagtgagactccgtctcgaaaccaaaaacaagaaaaacccctagttttgtgccttctgaagatagttaggacatct

SEQ ID NO: 451225 - DNA, 4994 bp, Homo sapiens
  misc_feature (2983)..(2983): n is a, c, g, or t
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttgtcacgagatataagaaagtgctttttgccttgaatggacaattttagggctgtgctcactagtcttttcaggctggactgaaatgtcgggcccatggagccctgtgttttgtgcatcgggntgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaatttgtgttccccagggcaccaaaacacagtgcttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcagactcaaa

SEQ ID NO: 451226 - DNA, 4778 bp, Homo sapiens
  misc_feature (2983)..(2983): n is a, c, g, or t
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttgtcacgagatataagaaagtgctttttgccttgaatggacaattttagggctgtgctcactagtcttttcaggctggactgaaatgtcgggcccatggagccctgtgttttgtgcatcgggntgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaatttgtgttccccagggcaccaaaacacagtgcttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcagactcaaa

SEQ ID NO: 451227 - DNA, 1416 bp, Homo sapiens
aaatgctggacatgccaaaaacctaacgcaaaacccaggacattccagcccaactgggacgatatcagagaccatcttcaagtgcaagaagcaggtgaaagcccaggaaattggcagagccaggattatcatccagtactttcatttcacaaatggagaaaccgaggttctgccagctagattttttttcacagtgtcactgctagcaagccactaagctggagctgggatttgagagctgctgctatttagaggatcttgggaataaaatttaaactggagtttaatggccctttcagttttgctataggcaagagaataaaatgaatgaatggataggtggctttatgggtgtaagaaagaagcgaaaaaaactcccaaaccccagtgttcctgaatatctgttctccccctgaccactctgggaatttatcaaatgcagctttgacctccaagccaagtaaactgctcttgttgctattttagtggtttttgtttttttaagacacaaggtctcactttgttactcaggctggagtgcagtggcatgatcataactcattgtaggctcaacctcctgggccccagtgatcctcctgcctcagcctctcaagtagctaaaactacagatgtgcaccatcacatctggctaatttttttttttttttttttgaggtggagtctcgctctgttgcccagattcaagtgcaatggcacgttttggctcactgcaacctctgcctcccaggttcaagcgattctccctgtctcggcctcccgagtagctgggactacaggcacctgccaccacgcgcagctaatgtttgtatttttagtagagacgggggtttcaccatgttggccaggctggtttcaaactcctgacattaggtgatccacctgcctcggcctcccaaagtgctgggattacaggcatgagccaccgtgccaagccacgcctggctaattttttaaaattattttttgcagagacagagtttcactatgttgcccaggctggtcttgaactccttggcctcaagtgatcctcccacctcagcctcccaaagcattggggttacaggcgtgagccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcagactcaaa

SEQ ID NO: 451228 - DNA, 1576 bp, Homo sapiens
tgtccagtaactctggctgtgccggatactgcttgggtaaaacgggcaccccaggaacatggcagacgaagacctcatcttccgcctggaaggtgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccgagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatgtaaggaacccccaggaaatgagaccggtgtcacctgttgccttgtttatcctccaggaaaatgaaaactccccttcctggagggggaatatgagtgggtcctgagaagataacaagtaaattaataaagagtatttcagg

SEQ ID NO: 451229 - DNA, 1873 bp, Homo sapiens
gttgctttgcggacgcttttccgcggggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagcctatggaaattcctagagacagataaatgtgcaaacctgttcatcttgccaagaaaaatccgcttttctgccacagaaacaaaatattgggaaagagtcttgtggtgaaacacccatcgttctctgctaaaacatttggttgctactgtgtagactcagcttaagtcatggaattctagaggatgtatctcacaagtaggatcaagaacaagcccaacagtaatctgcatcataagctgatttgataccatggcactgacaatgggcactgatttgataccatggcactgacaatgggcacacagggaacaggaaatgggaatgagagcaagggttgggttgtgttcgtggaacacataggttttttttttttaactttctctttctaaaatatttcattttgatggaggtgaaatttatataagatgaaattaaccattttaaagtaaacaattccgtggcaactagatatcatgatgtgcaaccagcatctctgtctagttccaaatattttcatcaccccaaaagcaagacccataaccattatgcaagtgttcctatttccccctcctcccagctcctggaaacccaccaatctactttgttgctatggctttacctattctggatatttcatataaatggaatcatatagtgtctgtcttctttcactagtatgttttcaagtctcctccatggtgtagcgtgcatcagtacttcattctttttatggctgaataatattgcattgtcagga

SEQ ID NO: 451230 - DNA, 1561 bp, Homo sapiens
gttgctttgcggacgcttttccgcggggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaaggccaagagaagccatagggatactgtgacctttgtctagagttgatgggggtgtgatttgtgaaataaaacaggaccgtactgcttggaagaaggaaacggaagctgacataatggggattaattagttgattgctgttgagatggtaacagatttgctcctaaaccattgagctagcgatttcagacctagcagggaaggtgaagatgaagaagcctttgttcaggtctctagatgtgtagggctgagggctttgccgccatgggatgtcaacagccataataataatttgcacttatatagcacctttcaaccaggcacctcaaagcggtttaaccacattaattaattaaagcccacaatcctcctggggagaggaggaggatgactaacaagatttgtaattacaggagggaacatttccgaataaagtattgtctaccaga

SEQ ID NO: 451231 - DNA, 533 bp, Homo sapiens
agtctcagtgcccactaagtgaaaaagctcagcagtttggctagcctcttagagtgatgctcaagtgtgctggggcctagtggagaggccaagagaagccatagggatactgtgacctttgtctagagttgatgggggtgtgatttgtgaaataaaacaggaccgtactgcttggaagaaggaaacggaagctgacataatggggattaattagttgattgctgttgagatggtaacagatttgctcctaaaccattgagctagcgatttcagacctagcagggaaggtgaagatgaagaagcctttgttcaggtctctagatgtgtagggctgagggctttgccgccatgggatgtcaacagccataataataatttgcacttatatagcacctttcaaccaggcacctcaaagcggtttaaccacattaattaattaaagcccacaatcctcctggggagaggaggaggatgactaacaagatttgtaattacaggagggaacatttccgaataaagtattgtctaccaga

SEQ ID NO: 451232 - DNA, 1311 bp, Homo sapiens
gttgctttgcggacgcttttccgcggggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagctggaaaatgaaaacattaaccttgattcaagactttgaaaactgtcgcaacccattggtgggtcatgaagtggaattgatgaatcacaaccagcatttgaagacagagagagagagaagacagaagaaagagtgaagaaaaaatatcagattatatcacacatattgtttcatttcataaaatatttcttgtgtg

SEQ ID NO: 451233 - DNA, 1543 bp, Homo sapiens
tgagcaagtgcgggatctggccagcacagctcggagtgccagcaggagcaagctctgtgtgggatccgcggccagaccaggcatgagctagcgagtgtgggatccggccagccactctgggagctgccaggagcaaactccatgaagggcccgtggaggcacccagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagcctatggaaattcctagagacagataaatgtgcaaacctgttcatcttgccaagaaaaatccgcttttctgccacagaaacaaaatattgggaaagagtcttgtggtgaaacacccatcgttctctgctaaaacatttggttgctactgtgtagactcagcttaagtcatggaattctagaggatgtatctcacaagtaggatcaagaacaagcccaacagtaatctgcatcataagctgatttgataccatggcactgacaatgggcactgatttgataccatggcactgacaatgggcacacagggaacaggaaatgggaatgagagcaagggttgggttgtgttcgtggaacacataggttttttttttttaactttctctttctaaaatatttcattttgatggaggtgaaatttatataagatgaaattaaccattttaaagtaaacaattccgtggcaactagatatcatgatgtgcaaccagcatctctgtctagttccaaatattttcatcaccccaaaagcaagacccataaccattatgcaagtgttcctatttccccctcctcccagctcctggaaacccaccaatctactttgttgctatggctttacctattctggatatttcatataaatggaatcatatag

SEQ ID NO: 451234 - DNA, 1966 bp, Homo sapiens
  misc_feature (1838)..(1839): n is a, c, g, or t
gttgctttgcggacgcttttccgcggggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagcctatggaaattcctagagacagataaatgtgcaaacctgttcatcttgccaagaaaaatccgcttttctgccacagaaacaaaatattgggaaagagtcttgtggtgaaacacccatcgttctctgctaaaacatttggttgctactgtgtagactcagcttaagtcatggaattctagaggatgtatctcacaagtaggatcaagaacaagcccaacagtaatctgcatcataagctgatttgataccatggcactgacaatgggcactgatttgataccatggcactgacaatgggcacacagggaacaggaaatgggaatgagagcaagggttgggttgtgttcgtggaacacataggttttttttttttaactttctctttctaaaatatttcattttgatggaggtgaaatttatataagatgaaattaaccattttaaagtaaacaattccgtggcaactagatatcatgatgtgcaaccagcatctctgtctagttccaaatattttcatcaccccaaaagcaagacccataaccattatgcaagtgttcctatttccccctcctcccagctcctggaaacccaccaatctactttgttgctatggctttacctattctggatatttcatataaatggaatcatatagaaaaaaaaaaaaaaaaaaaaaaaaaagaaaaaaaaaaaaaaaaaaaaaaaaaaaaaaaaaaaaaaannccctgtgtgggcggcttgggccaagtggtttttagattggggaaggtttatccttgcgccccaaatttgggttactttgcccatttccccttatagggggcggattaaaattaatgggccgggtttt

SEQ ID NO: 451235 - DNA, 1181 bp, Homo sapiens
gttgctttgcggacgcttttccgcggggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagtaagtttttctttttttctcttttttcttttcctttcttttgtttcttttatattacattcactgacttatggtatcaaataataaaattagaggaaaatgtaaaacagatgactttttaaaggtagtacagtctaattgctatagcaaacatcgccatcatcttaaattagctcatctgctgagattattttattattttaataatttgagtctggagtagatttaaacgatgtttttaaaagttcctatagtccctccttttcttccttctcattgtttactctttgtgtgtgctttgtatcacatttctcacactgcagtaaatataaagtagtaaaacttc

SEQ ID NO: 451236 - DNA, 1050 bp, Homo sapiens
gctgaattgcttttctctgttatctgcttctttgggattatgaccaccagctccatccatgttcctgcaaaatgacatgatctcacttttttaatagctgcatagtattccatggttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagcctatggaaattcctagagacagataaatgtgcaaacctgttcatcttgccaagaaaaatccgcttttctgccacagaaacaaaatattgggaaagagtcttgtggtgaaacacccatcgttctctgctaaaacatttggttgctactgtgtagactcagcttaagtcatggaattctagaggatgtatctcacaagtaggatcaagaacaagcccaacagtaatctgcatcataagctgatttgataccatggcactgacaatgggcactgatttgataccatggcactgacaatgggcacacagggaacaggaaatgggaatgagagcaagggttgggttgtgttcgtggaacacataggttttttttttttaactttctctttctaaaatatttcattttgatggaggtgaaatttatataagatgaaattaaccattttaaagtaaacaattccgtggcaactagatatcatgatgtgcaaccagcatctctgtctagttccaaatattttcatcaccccaaaagcaagacccataaccattatgcaagtgttcctatttccccctcctcccagctcctggaaacccaccaatctactttgttgctatggctttacctattctggatatttcatataaatggaatcatatag

SEQ ID NO: 451237 - DNA, 464 bp, Homo sapiens
tctgagatcccaggcagagagagagttgagcctctctgtgcaatgaagtgggaaatgttggggtaggaggggatctcatgaatccatttttcctttggtccccagagttcaccatgcaagtctcagtgcccactaagtgaaaaagctcagcagtttggctagcctcttagagtgatgctcaagtgtgctggggcctagtggagaggtaagagcaggagttggttctgggaatcagctttaatggtgtgtgcccacagaagcatctggcagcagaaaggaaagggagtttacagtgagctccaggttgacccacctctcctctggtcatgtcctttgttcccttagcaagccccgaatgttgtgccacccagaacacagctgggactcaaggccaagaataaagattctgtcattgaaagcagctgggctgtgttgctggcgctgcaggaggcctagaggaaaac

SEQ ID NO: 451238 - DNA, 1771 bp, Homo sapiens
gttgctttgcggacgcttttccgcggggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagcctatggaaattcctagagacagataaatgtgcaaacctgttcatcttgccaagaaaaatccgcttttctgccacagaaacaaaatattgggaaagagtcttgtggtgaaacacccatcgttctctgctaaaacatttggttgctactgtgtagactcagcttaagtcatggaattctagaggatgtatctcacaagtaggatcaagaacaagcccaacagtaatctgcatcataagctgatttgataccatggcactgacaatgggcactgatttgataccatggcactgacaatgggcacacagggaacaggaaatgggaatgagagcaagggttgggttgtgttcgtggaacacataggttttttttttttaactttctctttctaaaatatttcattttgatggaggtgaaatttatataagatgaaattaaccattttaaagtaaacaattccgtggcaactagatatcatgatgtgcaaccagcatctctgtctagttccaaatattttcatcaccccaaaagcaagacccataaccattatgcaagtgttcctatttccccctcctcccagctcctggaaacccaccaatctactttgttgctatggctttacctattctggatatttcatataaatggaatcatatag

SEQ ID NO: 451239 - DNA, 327 bp, Homo sapiens
ggggcgaggtgtattgctgccatcatgggagacacccacgacgggcttaaagattcttattgccaagtcccctctggctcccttcacctcatttgtctacaccatcaaggaggaaggcctggttcttcaagctggaaaatgaaaacattaaccttgattcaagactttgaaaactgtcgcaacccattggtgggtcatgaagtggaattgatgaatcacaaccagcatttgaagacagagagagagagaagacagaagaaagagtgaagaaaaaatatcagattatatcacacatattgtttcatttcataaaatatttcttgtgtg

SEQ ID NO: 451240 - DNA, 2566 bp, Homo sapiens
gttgctttgcggacgcttttccgcggggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagagacaacattttgctctgtcacccaagctgaactgaactgggctccagaaatcctcccacctcagcctcctgagcagctaggactacagatgtgccaccatacccagctaattttttaattttttgtagaggtggggtctcattatgttgcccaagctgatctcaaactcctggcttcaagagatccacccacctcagcctcccaaagcgctaggattacaagtatgagactttgccattccaatgagaattttgtccttagcaatctcatccaatggccactggagatgtgtgtagggccacaagaatgagaaagggggcaatggagtgacaggtgacctgctcaggtgcccctccccagaccaaatgtcccaggcacacagcccatgccctccaccatggagtacattttctccctggcttgctgctgagctaaaggaccagggacgtggaaacaggaggtgaactaaggcaccccgccacccactgtggcagcttgaatttcttgaggctgagacaaactaggatccagtagcctagattttgccccagtttctccactgagtatttactcagtgctcctgagccgatgccttcccctctgcctagatgaaccacagcattttggtaaatgcctcagcatgttaggagcgctggaacgtttattctcttccctcccaattatccactctaatggagcagaacacttacatggaaaatcctaaacatggaagatgatttaaaaatgattcaccctggaatacatgcttccagttgcttctacaggtttaccttgctaaaggcatttcgcttcctttgctgttacaataagcttgcctgccttgaagaaaagaagaccagggccaaagggaaatcagtcaagggagcctgttttgtctgaaataatgcatctatgaacaaatgaattgagtataactgtctttttacatcagtgtttctgtggaattaagagaacatccaaggccactcctagcttgagtagattaaatttgtccttgtgtttggagcaagggttgtgaagtctgtctggcccatcaaatgaccaatggcttttaaggaaggactaagtgacttatgaccagaacaagggagcagcctgagtcagtctccccaatgtctacattgtgttatttatactagcaaaaaaatagacacaactaaatgttcgaccatatggtattggttaaattaacatctatacgatggaatactagatggtcattaaaattatgtgtcagaagaaggcttaatctcatgggaaagtgttcacaccatattattaaagagaaaaaacagattataaagcaatatgcatacaatgtagtagttctgtaagaaaaaagtattatgtgcattttaactggaaaaatatgtataaaaatgttaacagtgcaatctctgggcaataagattatacttgacttttattt

SEQ ID NO: 451241 - DNA, 1721 bp, Homo sapiens
ttcttcttttctttgctggatctggaggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagcctatggaaattcctagagacagataaatgtgcaaacctgttcatcttgccaagaaaaatccgcttttctgccacagaaacaaaatattgggaaagagtcttgtggtgaaacacccatcgttctctgctaaaacatttggttgctactgtgtagactcagcttaagtcatggaattctagaggatgtatctcacaagtaggatcaagaacaagcccaacagtaatctgcatcataagctgatttgataccatggcactgacaatgggcactgatttgataccatggcactgacaatgggcacacagggaacaggaaatgggaatgagagcaagggttgggttgtgttcgtggaacacataggttttttttttttaactttctctttctaaaatatttcattttgatggaggtgaaatttatataagatgaaattaaccattttaaagtaaacaattccgtggcaactagatatcatgatgtgcaaccagcatctctgtctagttccaaatattttcatcaccccaaaagcaagacccataaccattatgcaagtgttcctatttccccctcctcccagctcctggaaacccaccaatctactttgttgctatggctttacctattctggatatttcatataaatggaatcatatag

SEQ ID NO: 451242 - DNA, 845 bp, Homo sapiens
  misc_feature (2)..(2): n is a, c, g, or t
cnataaaaataaaaaataaatgaaacaactgctctgtatcacggttcatagtcacaattctcccctaaatatttacctgtcaatattctcacggcatttttaaaatgttctcccagtactattaaaaaccatatggcaactatcccttataactcccgaatatttaaaacgcacgcagatataattttcacacggctttaagtgactttgatggacttaatcccatagaagaatctcagaaagactgtttaaagctgaacccttccatggattggacccatcaaatacctatgagttccagaattccgtccccttttgaggtcccgaggtaaaacttgggctcctgggcctgtcagaaagtgacattcttctcgtgccgaattcggcacgaggttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451243 - DNA, 546 bp, Homo sapiens
ctagaggatcccctcctttttttaaattttctccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagattttgttgattccatacagtttttgttcagacaggaagggataaaaatgaacttcgaacagaaaggggtagagactcttttcccattgtattctgctcaaggtatttccccccaaataaattgagaaccatggagtcgagaaaagagacctcaagaacagggcaaatgagcacaagagggaaa

SEQ ID NO: 451244 - DNA, 349 bp, Homo sapiens
aaaaatttttattaaagggaggaaagaaaagaggcttcaagaaaaggtggctctatggacccctggtggaatccaaccctcccttttttgactgccccccgctccaggggactagagaaaatctaaaaaaaggaaggttggaatcccccagttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatccctccacaggggacctcctgaacgactagtgcaca

SEQ ID NO: 451245 - DNA, 461 bp, Homo sapiens
aaaacgttccagtgtgctgaagccaagtattacagtagtttagggttctcattagatactacagatgtaggcaggaagatctcttgagcctaggagtttaccctgggcaacatagacccttaccttccaaaaaacaaaaaaaaagagaaaaatctagcccaagttaaagaattgagaactggactaaattttttgttgctgttgttttctgcagtggtgactgagctcttcaaatggcttgccatttctcaaaatcatttacatccgtatttaggtagtaagacatagtttagatatttatactgtgttgtgctagtggctgttaacagtggaactaattttatggaaaaccaaatgtagttgatactacctctacctgctgtacagttttataattgctcttaggtaataatggtagcgtagatagtatactgatatttgttttgcttagcttttgggga

SEQ ID NO: 451246 - DNA, 392 bp, Homo sapiens
  misc_feature (289)..(289): n is a, c, g, or t
  misc_feature (292)..(292): n is a, c, g, or t
  misc_feature (298)..(298): n is a, c, g, or t
  misc_feature (302)..(302): n is a, c, g, or t
  misc_feature (309)..(309): n is a, c, g, or t
  misc_feature (318)..(318): n is a, c, g, or t
  misc_feature (320)..(321): n is a, c, g, or t
  misc_feature (326)..(326): n is a, c, g, or t
  misc_feature (328)..(328): n is a, c, g, or t
  misc_feature (332)..(334): n is a, c, g, or t
  misc_feature (341)..(341): n is a, c, g, or t
  misc_feature (349)..(349): n is a, c, g, or t
  misc_feature (351)..(351): n is a, c, g, or t
tatctaagtcctgctgcatctcttgctctcattccttagacgtcctccccttttgaccccgattccttcatccatcctgcaccccagtcccccagccctaaatcctccctcctctcctcacatcctggtccctagcagtatagatagcctctgtgtctgaggatgaaggagaagatgactaaatagaacactgatggattccaaccttcctttttttaaattttctccagtccctgggagcaagttgcagtctttttttttttttttttttttttccctcttggggccnggnccccgngttntggggcntttttcctntnnccagngntccnnnattttanggggggancngggggggctcccctaaagggtacctggggggtttcacgctg

SEQ ID NO: 451247 - DNA, 733 bp, Homo sapiens
ctaacttggttggaaatacttatgtagattcagtgttttttggtgaagtgattgtacagaagtttttgaaagtgcattgaccttacaaggtttgggtttgctttcaaagactgaaaattgtctgaattgcagtgtaggtcttctgatggtttagcagtgtggcatcagtggttgctctaacttgccttacaactttgttatggattagccactttatttagaaatcgcgcttgagggaaacaattgaaattggactggaaatggagtgggcgaagtaaatacacacgttaccagagtgttgagtttgggcactcttaacagtcattattactcagtgtttattgataaatcagacaaaattgccatcttagttttgagtgtctaaattaggtgataatggttattataatttggttattttgcatgactcaagctagtaagtaaatacactctgtaatctcaaccaattttttaatttgttaaatactatcattgtcaacatctcttttcatttgcttcagactcgcgcaagggtagtacaggaacaaagaacgaaagtaacacaaagcaacagtgtcagagcgagcacggaagtcgagtacgactttaaagacagaactcgcctggctaccaagcgtgatctgcgaaccagcaaatagagagtgaaagcaggacatctgatagagtccggcgggattctctcagagctcgacctgacagcagcaagctgcat

SEQ ID NO: 451248 - DNA, 404 bp, Homo sapiens
ctaacttggttggaaatacttatgtagattcagtgttttttggtgaagtgattgtacagaagtttttgaaagtgcattgaccttacaaggtttgggtttgctttcaaagactgaaaattgtctgaattgcagtgtaggtcttctgatggtttagcagtgtggcatcagtggttgctctaacttgccttacaactttgttatggattagccactttatttagaaatcgcgcttgagggaaacaattgaaattggactggaaatggagtgggcgaagtaaatacacacgttaccagagtgttgagtttgggcactcttaacagtcattattactcagtgtttattgataaatcagacaaaattgccatcttagttttgagtgtcgggatcctctagaacgaacgca

SEQ ID NO: 451249 - DNA, 2918 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451250 - DNA, 2790 bp, Homo sapiens
aaactagcttatttttccatatagtaatgcagttagggttctcagcactttgtttcttatatccttgtgttagatcttcatattatgatcaaatgataatactctcaaggattgggtgcccggaccaaaatggggaccgtgtagagcggtgtgacagtaaagcgctggacagggtcattcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451251 - DNA, 3074 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagatttaaaaaatcaccaacaaaaccaaaccacaacccacaccctaacacctccacccccacttacaccaaccacacctcaaaccaacaacacaccccaaaaacccaatgcgctcccgctcccccatcacccacacctccacccccccccacagctgcccct

SEQ ID NO: 451252 - DNA, 2675 bp, Homo sapiens
gcggccgccccgtcgcgccagcgtgcggagaaacctggcgccgcgaccagtgtatcgggggtcttggaaatggctaagaaagctggcctctgcctaggaggctctcggcaggggggctgccaatccgggatggttaccggaaatgaaccgcgcgatctggccctttcacacccacttagctttgtaggggaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451253 - DNA, 3351 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagatttaaaaaaaaaaaaaaaaaaaaaaaaaaaaaacaaaaaagaaaaacaaaaaaaaaaaaaaaaaagaaaaaaaaacaaaaaaaagaaaggaggggagacagaaacaaaaaaaaaaaacaaggaggaaccacaaaaaacaagagaagacacacccacacaagaagagaccgcgaccacgcacctcaacgaaaagcgcagaagagcatgcagaagcagagaacactacacgcaaagctaacaacccacagtcgagtgacaagaacacgaacacaggaaggcgcagcgataagcgaacaaacacaacaaataatgactaagacaacaagagactaggctgactcttgttcaccaccgtaaagagaggacgcaccgacagcgtaacacatgcagcagcactgagtgacgcagccagtcacaagtaggcgcaccaacagga

SEQ ID NO: 451254 - DNA, 2467 bp, Homo sapiens
  misc_feature (32)..(32): n is a, c, g, or t
tcgagcggccgcccgggcgggcacaaaatganatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451255 - DNA, 2320 bp, Homo sapiens
tataacataacttggttcccgatatggatgatgaagaaggagaaggagaagaagatgaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451256 - DNA, 2087 bp, Homo sapiens
gctcttccggtattcatttaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451257 - DNA, 1930 bp, Homo sapiens
gggggtgatctagaggatcccggtatacataactggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451258 - DNA, 2655 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451259 - DNA, 2062 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaa

SEQ ID NO: 451260 - DNA, 1669 bp, Homo sapiens
ctcagagagtacactgtgtctctatgtgaatatggagagttagcatttacctacacgtatctgtctactgtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451261 - DNA, 1732 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaatagatatagcagacgctgcagtttatcctcaagagtcag

SEQ ID NO: 451262 - DNA, 1780 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatgttatgtataccggtataacataacttggttccccaaggcaggaggatcgcttgagcccaggaatttgaggccagcatgggcaacatagcgaaaccatatctctaccaaaaaatttttttttaaattagctgggcatattggggctcacctgtagtctcagctacccaagaggcttaggcaggaggatcacttgagcccagctggtcgaggcagcagtgagctatgatgaaaagaataagaaaaagaaaagaaaaggagaggagaggagaggaaagaagagaagagacgaacgaggagtttctgatcctgcacatgcaccttgatc

SEQ ID NO: 451263 - DNA, 1449 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctcgtcttcttcccttctgtcgtccttctaagatcctctagat

SEQ ID NO: 451264 - DNA, 1456 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtcttttttttcttcgattctttgttttgtgcccctctggtggctcccgtcgcgccgggtctggaaggcctctttgctgtcacgccggggttccccactacttcggggggggaacatacttggggcgaattcacggggaaggggttttaaccctttttggtccgacggtctttcttcccttcttgtttggacaaa

SEQ ID NO: 451265 - DNA, 1438 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatgggccatcttcgtcccatcagaatacatacaatctccccctctgctgggcgtggtgactcatgtctataatcccagctctttgggaggccagggcgggtggatcacttgagcctaggagttcgaaaccagcctgagcaacatggtgaaagcccatctctacgaaaaatgcaaaagttagccaggcatggtggtgcacgtctgtagacccagctacttgggaggctgaggcg

SEQ ID NO: 451266 - DNA, 1248 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggatattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaaa

SEQ ID NO: 451267 - DNA, 1070 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttctcgatatggatgatgaagcctcgtcggagggtcgggagctcga

SEQ ID NO: 451268 - DNA, 1090 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccgctctccgtccacacctgcaaagccaagacccttctgcagacacgaatgtccacggagcccgccggcaggtcaggaatacaccatgctt

SEQ ID NO: 451269 - DNA, 941 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcttgtgaatttttgttttactgtttaactttatta

SEQ ID NO: 451270 - DNA, 313 bp, Homo sapiens
ggactctgactccgggggccaatgcccttgtgggcaggaacggcctcgtcgcgtaggtctcaatgctggtgatccttcttcagctcgacctgcagtgctgcttgctcggaagtgaccgtctggacacgaccgtcgtgcttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451271 - DNA, 469 bp, Homo sapiens
gtaagtatctctaacttaatcttgtttgccactgtggaaattaatgtgagctttggttggaagacctgttcatatttctaatctttcaattatttattacagtattttgatgaaaatccttactttgaaaataaagttctctccaaagaatttcatctgaatgagagtggtgatccatcttcgaagtccaccgaaatcaaatggaaatctggaaaggtatgttttgaggaattatttgacaaaaatagcattttgcctatttcagtttagttttaaccacttacaagtgcttgatactttggtcatgtggctaaatacaaaaccttaaaatataaaacgttccagtgtgctgaagccaagtattacagtagtttagggttctcattagatactacagatgtaggcaggaagatctcttgagcctaggagtttaccctgggcaacatagacccttaccttccaaaaaaca

SEQ ID NO: 451272 - DNA, 350 bp, Homo sapiens
gtgtgtgtcccactgtcatgtaaatatcccttccaggcagggcggctccagtgcagatttaagccgctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggcttgccgaagaagggaggtacgtttctgcgctaagttttattggagatttaagggatttgcaaggattgactctctgatttttaccccccaatccctcttgag

SEQ ID NO: 451273 - DNA, 2749 bp, Homo sapiens
gtgtgtgtcccactgtcatgtaaatatcccttccaggcagggcggctccagtgcagatttaagccgctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggcttgccgaagaagggagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451274 - DNA, 2963 bp, Homo sapiens
gcggccgccccgtcgcgccagcgtgcggagaaacctggcgccgcgaccagtgtatcgggggtcttggaaatggctaagaaagctggcctctgcctaggaggctctcggcaggggggctgccaatccgggatggttaccggaaatgaaccgcgcgatctggccctttcacacccacttagctttgtagggggtttgtagtctttacaggacaaaagggcacctattccagagcacacccccttttcttcctctcccttctgtgcctcactgctttccgatctcatagttgctcccagtaagtgctccaaagtcgtgtggggccgcatctgaggtctgcccgcctgaattgggttggaggggttcatgttctgagaaggcgaaggccagggtgtaggatggtgccccgtgactttccagtctttgtaggcgtgcctggtatcttcatcgtaatagcagagtcgtcaactttctatgaaagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451275 - DNA, 2547 bp, Homo sapiens
ctagaggatcccctcctttttttaaattttctccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451276 - DNA, 2863 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaatttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451277 - DNA, 2219 bp, Homo sapiens
aaataccagcgcgaatacacagcgtacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451278 - DNA, 2864 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaagggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcataatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 451279 - DNA, 2495 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaaaaaaaaaaaaaaaaaaaaaaaaaaaaaaacaaaaaagaaaaacaaaaaaaaaaaaaaaaaagaaaaaaaaacaaaaaaaagaaaggaggggagacagaaacaaaaaaaaaaaacaaggaggaaccacaaaaaacaagagaagacacacccacacaagaagagaccgcgaccacgcacctcaacgaaaagcgcagaagagcatgcagaagcagagaacactacacgcaaagctaacaacccacagtcgagtgacaagaacacgaacacaggaaggcgcagcgataagcgaacaaacacaacaaataatgactaagacaacaagagactaggctgactcttgttcaccaccgtaaagagaggacgcaccgacagcgtaacacatgcagcagcactgagtgacgcagccagtcacaagtaggcgcaccaacagga

SEQ ID NO: 451280 - DNA, 1764 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaagactgcaacttgctcccagggactggggaaaatttaaaaagggaggttgaatccatcagtgttctatttag

SEQ ID NO: 451281 - DNA, 1490 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatccctccacaggggacctcctgaacgactagtgcaca

SEQ ID NO: 451282 - DNA, 1332 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggaagccagagccgctgccatgccccagccagtccccacagcataacaggctctccttggcagctgtattctggagtctgcatc

SEQ ID NO: 451283 - DNA, 1228 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaggaggcactgcattatttgaccagagttgaagtgacagaatttgaagatattaaatcaggtacagaatagatttttattttgatga

SEQ ID NO: 451284 - DNA, 1616 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggatgtctgaagagtcagatgatgacatgggattcggcctttttgattaaattcctgctcccctgcaaaataaaagcctttttacacatcaaaaaaaaaaaaaaaaaaaaaaaaaaaaaaaaaacaaaaaagaaaaacaaaaaaaaaaaaaaaaaagaaaaaaaaacaaaaaaaagaaaggaggggagacagaaacaaaaaaaaaaaacaaggaggaaccacaaaaaacaagagaagacacacccacacaagaagagaccgcgaccacgcacctcaacgaaaagcgcagaagagcatgcagaagcagagaacactacacgcaaagctaacaacccacagtcgagtgacaagaacacgaacacaggaaggcgcagcgataagcgaacaaacacaacaaataatgactaagacaacaagagactaggctgactcttgttcaccaccgtaaagagaggacgcaccgacagcgtaacacatgcagcagcactgagtgacgcagccagtcacaagtaggcgcaccaacagga

SEQ ID NO: 451285 - DNA, 1135 bp, Homo sapiens
cctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgactatttgtggctagtcccctccccttcgctcaacaagattttaaaatgttaaccttaaaaaggaggagtacgtttattgggtcctttctttgcccttccctccacatttcatctcccattagatatatgatatatttttaaaccatatgaacaaatgaaccttgaaacgg

SEQ ID NO: 451286 - DNA, 4339 bp, Homo sapiens
tcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgcagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaagatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccaccacgatggtcccgagtagcatctctaacaaataggctggtggatccaagtacgtcggttatttccatattcatccccttttcgatttccattccatccttgaaccaagttact

SEQ ID NO: 451287 - DNA, 3837 bp, Homo sapiens
tcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgcagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaagatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatggtaagcatttacaacttatttccaatgagactaagagcattcacatttttaaaaaacacatttggcccctggctcgtaaaatggtaacagaaacaaattacccaaggttgctaagtggatgaattatgtctttctacctttcagatgaaaagaagaaaaaaataattgggcatcaattattttttctattatttcactccattcccatataaagagcatgcagcaagtgggaatgagtttttagctttgtaattttcgccacttaacagtacataaagaaaaggttctcgagaataagtgtccatctttactgaa

SEQ ID NO: 451288 - DNA, 2735 bp, Homo sapiens
  misc_feature (2692)..(2692): n is a, c, g, or t
tcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgcagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccaattccaatttcattttctgcaaggactctgaagaaggatggagtcttctccgacaaatctattagcttgaaggatgtgctaggancatttgtgtgacacgggcagaccatgttctcttggtggcatct

SEQ ID NO: 451289 - DNA, 5964 bp, Homo sapiens
tcaaagaactctgtcagcctttcatggcaacaaccagctttcgatggaggtagcaagattacaggctacattgttgagagacgtgaccttccagatggcagatggaccaaggccagcttcaccaatgttactgaaactcaattcatcatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatgggctcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgcagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaagatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaaggccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatg

SEQ ID NO: 451290 - DNA, 3929 bp, Homo sapiens
cccagctgaggatgacagatgtctttgttgagtctttcattgagagatcacgtataggagctggtacttcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaagatggtgtgttcaagtgttgccagaacgactttcaaagttcctaatctagtcaaagatgctgagtaccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccgacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaaggccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacagaacagcctgctccacctaggagacttgatgttgttgatactagcaaatcctccgcagtcttagcttggcttaaacctgaccacgatggaggcagccggatcactggctacctgcttgaaatgagacaaaagggatctgacttctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatg

SEQ ID NO: 451291 - DNA, 201 bp, Homo sapiens
cgtcgacagggcattaacgatctctcaaaactgatcagttttggcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451292 - DNA, 600 bp, Homo sapiens
  misc_feature (600)..(600): n is a, c, g, or t
gtttttcaaaaagcttaatgtttccctagattctgtcactgtataggattttagaatgttgtatttaatatgttcgccaactgcatgttgttaatttagatatattttgttttcaattccagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcagcttggtggggaatcactagtgaattcgcgcn

SEQ ID NO: 451293 - DNA, 477 bp, Homo sapiens
ctctctccacactggaaccacagaacttactgaatgagggccattcctctttaagttttcttttcatctgaaaaccctattatctagcaataagttaaattagagacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcagctttcctgaatgtattggaccgtgtggagagaggggatccccagagt

SEQ ID NO: 451294 - DNA, 539 bp, Homo sapiens
cacgcaaccctcatctcgacagcgctcggcgccccttacgccactggctcagcctcagagacttcgcgaatatggctttgcgcactgcggcggggctgcgccgcaaccgagctcagccctgtggctcctcctcgctgccctgcgcggattggtggcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtgagttgagccgtgccgccgccgagtggagcgctctaaaatggccgccgtccc

SEQ ID NO: 451295 - DNA, 1048 bp, Homo sapiens
cacgcaaccctcatctcgacagcgctcggcgccccttacgccactggctcagcctcagagacttcgcgaatatggctttgcgcactgcggcggggctgcgccgcaaccgagctcagccctgtggctcctcctcgctgccctgcgcggattggtggcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgactcctctgagctgagtttgaggccgtccccgactccttcctcccccgttaattctaacttagtattagtgaagctcacttctgacttcttgcgcacgtaccattctacataatactcttgctagacagagtatgcttcgccgtgcatgcgtaattcagtggtgagttcctacggagtctgcacttacagattgtcacggtgattgctaggatgaacctagttactccttactactgtctttagtttaaagtccttgtcgtcttctaaggtaccaatttcacattccagagcccccgattgtgctttacgtccagctaatcgtctaagtagtctgcacggtggtcccctcttggcgttgtctctaaacactctttatctctctttgcttcatcgtccgatagcgtcttgcaacacgtgtaagtggacattctagagtggtttagcgcttcgtgggccacgaactgcactagctcgactgttgtgtggcttaggcagccgctctttggtgccaagtgccctacatcgtgagcaattcgtgcagatttttagagcgtggtagtactctcgtactagtatccgtgtcgttatgccacagcaagatccaggtacgccaaagcccttttctagtcttgcagccgttactatttacaacacaacggactgcacagaatccagtaagcagtggtcacacttgcgatgtacatcagttgttcaccgacac

SEQ ID NO: 451296 - DNA, 4057 bp, Homo sapiens
cacgcaaccctcatctcgacagcgctcggcgccccttacgccactggctcagcctcagagacttcgcgaatatggctttgcgcactgcggcggggctgcgccgcaaccgagctcagccctgtggctcctcctcgctgccctgcgcggattggtggcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaagtggagagtgcgattgcagaagggggtgcttctcgtttcagtgcttcttcgggcggaggaggaagtaggggtgcacctcagcactatcccaagactgctggcaacagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaaggggtcatactgctgattgtggacaaagccctagaagagccaaagtatagctcactgtatgctcagctatgtctgcgattggcagaagatgcaccaaactttgatggcccagcagcagagggtcaaccaggacagaagcaaagcaccacattcagacgcctcctaatttccaaattacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacacttttggaaaagaagaagagagtccaactcaaagatatgggagaggatttggagtgcctctgtcagataatgaggacagtgggacctagattagaccatgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451297 - DNA, 510 bp, Homo sapiens
tggtacaaaatggcggccgcaggcggagccgggtggggcgacccttttttagcatttcctctgcgcttcagacacctggaaagtcttggcttttgttctctcttcctgttgctgacggagtagaaggaaaacgtcagtgttggccaggccgccgtgcggtcatggccggatggccgacgcctgcagggacgaggccgtggcggaccgaggcacggctgtgctcggacggcgagggagcgtggctcggaccgctagcgccgtggcgggaggcacgcgggccggcagggaaggccaggccgttggcgcgggaccagggaaccgcaggcgtcccggagcctggcctcccggcggggaggtgtgtaggacctggagtcggcaggggctgcccttcgtcggggaggaaagagagagtgatgatttctgccccttttgtcagcagaggaggccgtggcgaggcggttgtcagtcccggggggatttatggtgcaggagggggcccgcttggaggcg

SEQ ID NO: 451298 - DNA, 2830 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggtaagtaatatttgagtgtgcatgttttctaaaccttatctgcaacatttatttcaaactgaaatgtttatccttaagattagtaaagtattagtaaaatcacatcactttatttgataggttagatttttattcttccctgtttcatcttttactttctctgggcaaattcagttaaactaactttatggcttggctcatccctttggtacttgattaccataatttgtggacccctttttatctagactttctttctccttttctgaaataggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451299 - DNA, 2639 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgtaagtttcaaatatcccattttagtgtaattagcctgtatttgagatagagaatacattaaagatacttgtgttcttcacaggaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451300 - DNA, 2889 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccaggtaagagaatgctgacttgtttgttttgtttttttaatattatatctagagatttcaggtaccttgagtggatttatgtaggtcagacagtctgattgtcctgctcagataatgataaacattaccacagatctcacctataaagagagatttataatttaactactttcatttgatccgtatgttgagtttttttcatttgctgggttggttctctattctgctacatggatcttacatacttggggacatcatttgtgaagctctgctctctggacaggacaacttggtaaaatgaactattagatgatgcaggtggctttgtctcttcagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451301 - DNA, 2492 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaagctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451302 - DNA, 2612 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctctaactgttctttggaaggagcagaggatgaatctgtttcatcgctgggggggtttacttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451303 - DNA, 2408 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagtaacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451304 - DNA, 2962 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaagggccggtgttttaaaaccttgggaatgggaaaaccctggggtttcccaatttaaaccccttggaaaaaaatccccttttcccaggtggggtaaaatccaaaaggccctcccccttcgccctttcaaaaaatgtcgccacccttaatgggcaatgggaaattggaacgcgataatttttgggaaaatccgcgttaaaattttgggaaaaaccccttttttttttaacccaaaggcccaaaatcggcatcccctttttatttgtggcccgcg

SEQ ID NO: 451305 - DNA, 2581 bp, Homo sapiens
  misc_feature (2574)..(2574): n is a, c, g, or t
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgaaaaaaaaaaaacaaaaanaaaaaaa

SEQ ID NO: 451306 - DNA, 2534 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaaggtcctaattttaaggatgtcaggctcgatttactcgatcattaatccatgggccg

SEQ ID NO: 451307 - DNA, 2452 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaataaagagttttcagtgctgataggtggtgctatgatcgatggtgtagaaattgaa

SEQ ID NO: 451308 - DNA, 2350 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtattactgagcaaagtgcatttctacagtattcagtgttgctattcagttttctgtgtagaaattgaa

SEQ ID NO: 451309 - DNA, 2269 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcactgatactgggaatgccttgtccgatatggggggccattgggtcccctggtgttcgaacaacctacggtggggggggcccaaaatatggggttcacccacaagggggggagaaaaacgcgcggaggaagcctta

SEQ ID NO: 451310 - DNA, 1036 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451311 - DNA, 2555 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaagcatgtcacttcgcttacctgtgcacttctatgacatggaaacattatccgaccagcaagaagctataccttggcctctggccacgacagaatactaaccccacagacgttacccggcgcaacaaggccaagggctatcggtatccagagttgcacattcagctcggcctcacaccttgggttcaaccaacacttgtctgcacagcacacaaataaacatcaccaagcgaagagccaacgcctggcacattcacccgaaaccccaaggccaaaccagcgcccttacacacttcggctggccacaaaatccataccgtggacacggccttaattgaccctggttaaaacgttggcccgattaaaggaaatccttcaaaacccaaccatggccgtaaaccacacaatccacactataccccgcactggactcaacatcgataaacaaccatctaaaagagtaacatctacataaacaagacctatgcaaaaaccgccacaggctacacaacccctacaccgtgcaacatctctcccccctattccattggccaattaacagctgtcaccatcaatctctccgcgctcacgacgcgcatcaaacattggcttcccctatcaccactacccaaatataacaaccttccttaataccccaactatcaacaaaccaccacactcccacaaccgctcaaccctcacccccaattctcaacccctcagctacacaccccaaatctacccccactttcactcacacacacccagcaccacagggtacaaaccacccaaaccctcgcacacccgactcccgaacctaacacgactgattcaactgccaaacggggcacacagcaagagtgccacaagaccaccgtaaattctggggcacaaaaagacacaccactgtaccccttacgaggactaaggagacacaagcgcaaatgtcacaa

SEQ ID NO: 451312 - DNA, 1354 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctacaagaataaaggatgcagaacagaataactgacgcactggga

SEQ ID NO: 451313 - DNA, 931 bp, Homo sapiens
  misc_feature (931)..(931): n is a, c, g, or t
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaacttggtggggaatcactagtgaattcgcgcn

SEQ ID NO: 451314 - DNA, 755 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactggagctgttgtaactggggctgttgtaactggagctgttgt

SEQ ID NO: 451315 - DNA, 639 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacaggtcgacgcggccgcgaatttagtagtagta

SEQ ID NO: 451316 - DNA, 507 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagcggatcagcctaagcggatcctaagcggatgagatcctctagagtgac

SEQ ID NO: 451317 - DNA, 902 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggtaagtaatatttgagtgtgcatgttttctaaaccttatctgcaacatttatttcaaactgaaatgtttatccttaagattagtaaagtattagtaaaatcacatcactttatttgataggttagatttttattcttccctgtttcatcttttactttctctgggcaaattcagttaaactaactttatggcttggctcatccctttggtacttgattaccataatttgtggacccctttttatctagactttctttctccttttctgaaataggggctaagccagctctaccataaccagagtcagggactcttatcccagctgcaaggacagtcgaaggatatgccacctcggttttctaagaaaggacagcttaatgcagatgaggtacatttgcctatgttacttatataccatagtttgtccattcagaaatttattgcccgatgattataaaaagacgcgttattaagaggactttatgctggagttcttgacgtttttctctcttttctatacttctttttctttc

SEQ ID NO: 451318 - DNA, 236 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccagtagcgaagagtaggtacgacgtactctc

SEQ ID NO: 451319 - DNA, 967 bp, Homo sapiens
ataaactgttgtatatttctttcaagctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaagaagaattccaaaggatgttattcggtttttgtgccttcatgacatggaattggagaggagttttgggtggaaggagatattaccagagttcggaacgcaggttgtccgggatcagcgctactgttgacgtggacgagatgagagaagggtaggacggcagttatgtgaaattgggtagttttaggttggcacaggaaatcggtggtacttaggaggggagacttgaaggtgggggtacacataggttggtaagaaataagaggtgt

SEQ ID NO: 451320 - DNA, 490 bp, Homo sapiens
  misc_feature (446)..(446): n is a, c, g, or t
  misc_feature (458)..(458): n is a, c, g, or t
  misc_feature (460)..(460): n is a, c, g, or t
  misc_feature (466)..(466): n is a, c, g, or t
  misc_feature (468)..(468): n is a, c, g, or t
  misc_feature (471)..(471): n is a, c, g, or t
  misc_feature (483)..(483): n is a, c, g, or t
cacgcaaccctcatctcgacagcgctcggcgccccttacgccactggctcagcctcagagacttcgcgaatatggctttgcgcactgcggcggggctgcgccgcaaccgagctcagccctgtggctcctcctcgctgccctgcgcggattggtggcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgactcctctgagctgagtttgaggccgtccccgactccttcctcccccaaaaaaaaaaaaaaaaaaaaaaaaaaaaaaaaaaaaaaaaaaaaaaagaagaaaggataatgaggaggaagcngcggtggcagangntgagtnanaanagaaggtatttnatttata

SEQ ID NO: 451321 - DNA, 2556 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451322 - DNA, 2442 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451323 - DNA, 3219 bp, Homo sapiens
  misc_feature (3212)..(3212): n is a, c, g, or t
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgaaaaaaaaaaaacaaaaacaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaagggggggcgcgagcgcagcacattaatataactccgctaccagggggagccacgacacacttccaccccgcacagatattttaagtaaaagaggcggccactccaaaagtgataggatctatataaaaaacaacaagacggcggccgactataaaaaacgactaggagaggaaaaaacataagtcacacgttacttatatgagaaaaaccacacacaacctagagggtaggcaaccaaataggcgaagtacacccaacaacgaacaaaagtaaaatagtagccggcaggaggaaaaaacaacaacaaaaagagtaatataatgctcaaaacaaccccaaaggacacataattaggcgcgcagaaagaacaaactcacgaaaccacgcgaaatcagtaatacaaacaataactaccgacggagtgaatgaaaataataagaaacacagaaacaagaagaagagacaaacgcgagcagacaagaaaacaatgaaagaaagaaaagagaaaaaaaaaaaacaaaaanaaaaaaa

SEQ ID NO: 451324 - DNA, 2574 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccaggtggctttgtctcttcagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451325 - DNA, 2683 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactaggtaagacgaatggttttctgcatatggtaatgtttcatgtactagaaaagaagcgtaggagactaagagttgtctcttgagcaagaaaactcactgttgggttctaacaagacctctttctgtccagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451326 - DNA, 3166 bp, Homo sapiens
  misc_feature (3159)..(3159): n is a, c, g, or t
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgaaaaaaaaaaaaaaaaaaaaaaaaaaaaaacaaaaaaaaaaaaaaaaaaaaaaaaaaaaaaaaaaaaaaaaaaaaaaaaagggggggcgcgagcgcagcacattaatataactccgctaccagggggagccacgacacacttccaccccgcacagatattttaagtaaaagaggcggccactccaaaagtgataggatctatataaaaaacaacaagacggcggccgactataaaaaacgactaggagaggaaaaaacataagtcacacgttacttatatgagaaaaaccacacacaacctagagggtaggcaaccaaataggcgaagtacacccaacaacgaacaaaagtaaaatagtagccggcaggaggaaaaaacaacaacaaaaagagtaatataatgctcaaaacaaccccaaaggacacataattaggcgcgcagaaagaacaaactcacgaaaccacgcgaaatcagtaatacaaacaataactaccgacggagtgaatgaaaataataagaaacacagaaacaagaagaagagacaaacgcgagcagacaagaaaacaatgaaagaaagaaaagagaaaaaaaaaaaacaaaaanaaaaaaa

SEQ ID NO: 451327 - DNA, 2605 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgaaaaaaaaaaagtagaacgatgcaaccctaaattaagtgataccatcgaa

SEQ ID NO: 451328 - DNA, 2536 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctagaacctgattagactggcggtct

SEQ ID NO: 451329 - DNA, 2503 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 451330 - DNA, 2484 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgcggggggggcccccccctttttta

SEQ ID NO: 451331 - DNA, 2774 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccagggtaagtcttttgttaaaaatttggtctgcttacttcagtttgcttggtattaacttcaagttaagagcctttttcaactgaaatacaggcaaggtagtcctagttagtagtttgtcttcacctgtacatttcattctgcactatttgaagctatgattaagtaaagctacacaatgaatcaattctagtggtgtataagatgttagaggtagctaacttttcaaggagtatagctacttatatacatgggagtgactgtacaagtttcgatttaagcttttttaaaaacatcagtaaagaggaaattgtagctgggcacgtggctcatgcctgtaatcctagcactttaagaggctgaggtgggaggatcacttgagctcaggagttcaagaccagcctgggcagcatagtgaaaccctgtctctaaaaaatacaaaaaattagccagacgtggtgacatgttctgtggtcctggtcccagctactcgggaggatgtcttgagcccaggaggcagaggttgcagtgagctgagatcacaccactgcactctagtctgggcaacagagtgagactgtgtctcaaaaaaagaaaaaaagtttaaatactatatatttttctaaaaagaggagatgtttctgatttctcacaatttgatttttcttattgaatgaacttgtagccctaggggaagaacatcagggcattctctcaaatcacctgaagagcagtttaaaaagcaggttccaggcctattcctagagattctggtttagtaggtctgtggtacaaaatccaggtgattctttctcatgctactagttttccagggggcccaggcttgagaaacattggtcctgcagcatcttcctacctttttattgctgatgataaacaagattcacgaggatcatccttgcaggattaaatctttagctctgtgttgtcccaaatctggataatataccactgttcgttaacttaatatacaaattgttggtagggatatccttgtttcatattctaaaactgtgtagtaccacctaa

SEQ ID NO: 451332 - DNA, 1411 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccactcctcaaattggagaaggaactgttgaagcaaataaagttggatccatcccctcaaaccatatataaatggattaaagagaggcccaagaaagaaattaaaaagaagaggtggaaccgtcccaaaatgtcccttgctcagattaaggatagag

SEQ ID NO: 451333 - DNA, 1307 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtctcaaaactaatccaccacttatccaggaaaagcctgccaagaccagcaaaaagccaccaccgtcaaaggaagaactccttaaactaactgaaactgttgtgactgaatggtcgtcgaagttgcttcgacggaccattcaccaagcaactccatccctagctatagatacccaggaaaataagtatgtatcttcacagaaataattgtatgagaatattcatagttacttatgcacagtagttatcaagtaaacctgtctcccatcagaaaaatggatataaaattgtgtgataatcatacactcaataggatattacttggccaaaacaaaatgaaacaagggaaaaacacaatcaaacaaattagtggcatatatacccacctgagtaaagagaagtcggccgtgagccaccatgcccggcctcttttttatatttaaaaaatatcattttatatattaccagggcaaaagagaaaactcgtatgattacgtggtcatacacagtaaaagcatttggcaaaatggaaaacttttttcatgatttataaaaacaaaccccagaaaatgctcagcatgatgagaacagaaggcacacttccaaccccattaagggcagatttgaagaaccacaggtacatttattaatggctaagatgatgcgtcgcggggatctcagatcgc

SEQ ID NO: 451334 - DNA, 668 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattcctcctagtgcacaaccaccacgcactcaaacaccacctctgggacagacacctcagcttggtgcgaatatctaatccccagtgaatccaggtttggcggggataca

SEQ ID NO: 451335 - DNA, 590 bp, Homo sapiens
actacatacttccggactacatacttccgaaagacgatcaatcaaattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggttttctaagaaaggacagcttaatgcagatgagattagcctgaggcctgctcagtcgttcctaatgaataaaaatcaagtgccaaagcttcagccccagataactatgattccgtcactgcggggtcctctagagtcggc

SEQ ID NO: 451336 - DNA, 3834 bp, Homo sapiens
  misc_feature (3106)..(3106): n is a, c, g, or t
cccggcgtctagagcggcggcggctggctagggctgcggcgcgcgtggagggttcgctgctggtttgccgccgggtcgggctccgtgggccggggcaggaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagcattggaacacgggaggtagtcacccagaanaacttgagcggcctggtgcccatccgagacttaaggctagaccccagcctcctctgttccatccctttattagctctgagccccaatttactgattgtgtggctctttctgagcatagcatacctggtgaccaaattgcgttgcaaatgaatatcattatgaaaaattaataagtcacaagaaaaacaaaagtgccagaacatgtccagccaccgtgtacctaactggacagaaggaatgtgtcaaaccgtggtctgccaagaaatatttcatgccttacattttgacgttttgttcttctgaactgtaaatatctgccaaattatttcaccaagaagacttgtttgtttagctcctgtagcatcttcagtgcttgtaacatgttcttacggtgccctgtcactgcatcgtttagctggcctggaattccttgtaccacgtctctaccttctgatgtacaactatttatcacctgtacctctcatgtgccctgtttccaagagaaacgagttctgtttaaagagaatttgtatatttgatactattctttaagtgtactgctaacccttcctttccttttgatgacaaacgaaaagaaaaaaacatgctttataactggcttatctagaaaaacctatctaataggacatgtactttctgctttcatttcaaagcgtagtccctgaattacagtagcaaacagtttgcagaatcctaccatttccttg

SEQ ID NO: 451337 - DNA, 1853 bp, Homo sapiens
  misc_feature (1125)..(1125): n is a, c, g, or t
ctggggtgttcctgtccccagtcctggggctgaacccctcgaagtaggccttcctgagtagccacagggccccgccagcctctcctggcagggaatgtggcagtgggtcggtgctccgcagcttgggaattgtgccctctcagaatggcacattccagcagggccatgggggcttcggggctcctctgggagagctggggagggctctgtgtgaagaggaaccctgggcctcctgcctccccatctccaagtggagccttcacaggctgcctgctgtgtcctcaggcctctgattctgtgtcactgctgccacttggcagacataaatgtgcttccagagtcatgtggttctaggtaccatctcacctcagtgcagttcttctgtagcaccaaaagggggaagaagccccaaatttctagtgtggtattgtttggattccacccttggggatgctttcagaaccctaacttgcaaagatggaaacagcagtcgctcatgcctgccactgctgagcctggaacccgaggcggggctggtgggggctctgcgcttggttggttggtacctgaggtaaatggtttttgtttgcgtggttgatcaagaggcagctttggccaaatcctttgtaccaccccctgctcaggcatctgtgagaaggtcaaatccccaatggttcttcatgttccgcttgcttctcagaaatccctgtctgtgcagcatgtgggggcatggccgggcagcatggagttgtgcttggccagccgagagagtgaacatggaaaaccattcgttcaacctacatgtgtttattttcagtagattgcagtattttttcttattttcacttctctttctctccttttttcctgtaactgtgctggttttgttttggtcttcctctcatacccgtttctgcatttcatcttttctttctattgtgacttcatttcatttttttttaaccttatcttttgtttctcttgtttatcccatcctttttgataaaatccatcgcatgtgtcttctttttttctttattttctttcctttcctttttcctttttctttctcccaaactttttccttttcacagcattggaacacgggaggtagtcacccagaanaacttgagcggcctggtgcccatccgagacttaaggctagaccccagcctcctctgttccatccctttattagctctgagccccaatttactgattgtgtggctctttctgagcatagcatacctggtgaccaaattgcgttgcaaatgaatatcattatgaaaaattaataagtcacaagaaaaacaaaagtgccagaacatgtccagccaccgtgtacctaactggacagaaggaatgtgtcaaaccgtggtctgccaagaaatatttcatgccttacattttgacgttttgttcttctgaactgtaaatatctgccaaattatttcaccaagaagacttgtttgtttagctcctgtagcatcttcagtgcttgtaacatgttcttacggtgccctgtcactgcatcgtttagctggcctggaattccttgtaccacgtctctaccttctgatgtacaactatttatcacctgtacctctcatgtgccctgtttccaagagaaacgagttctgtttaaagagaatttgtatatttgatactattctttaagtgtactgctaacccttcctttccttttgatgacaaacgaaaagaaaaaaacatgctttataactggcttatctagaaaaacctatctaataggacatgtactttctgctttcatttcaaagcgtagtccctgaattacagtagcaaacagtttgcagaatcctaccatttccttg

SEQ ID NO: 451338 - DNA, 6648 bp, Homo sapiens
cccggcgtctagagcggcggcggctggctagggctgcggcgcgcgtggagggttcgctgctggtttgccgccgggtcgggctccgtgggccggggcaggaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatggaaagtgtctttattttttagggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgtttaactcttggagtttttagtattaccaaactcctagaaatttaagctaccaccaaaaataacatgtgccttttccctttattctcattgatggtagcagtgcacctcgtttcagtgtcctgattccttgattactgtgaacactgaacatcttttatacctttatgatatttctatgtttgtgacttcattggaatgttgatctatttcatatagattgtttttaatatacaatgtattagcccctgtcatatgttgcaca

SEQ ID NO: 451339 - DNA, 6506 bp, Homo sapiens
cccggcgtctagagcggcggcggctggctagggctgcggcgcgcgtggagggttcgctgctggtttgccgccgggtcgggctccgtgggccggggcaggaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaaggtaacccggacagccacgcctactggatcagaccagaagaccccttctgtgatgtcccctcctcaccatgcccctccaccatgccctccactgcatgccatcctcatctgaccacacattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatggaaagtgtctttattttttagggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgttta

SEQ ID NO: 451340 - DNA, 5670 bp, Homo sapiens
atgacactaacgtcaaagggtacagtgttgagtagtcataagatagatctcacgcaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatggaaagtgtctttattttttagggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgttta

SEQ ID NO: 451341 - DNA, 3358 bp, Homo sapiens
tccttttttactgccgtcatttcttgtgcttgttttttccccagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatggaaagtgtctttattttttagggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgttta

SEQ ID NO: 451342 - DNA, 2542 bp, Homo sapiens
cccggcgtctagagcggcggcggctggctagggctgcggcgcgcgtggagggttcgctgctggtttgccgccgggtcgggctccgtgggccggggcaggaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaaggtaacccggacagccacgcctactggatcagaccagaagaccccttctgtgatgtcccctcctcaccatgcccctccaccatgccctccactgcatgccatcctcatctgaccacacgtgcgtatgcatccatgcttcccatatgctgcctccatttcaccttgtgctgcttccatttgtctgtgtctctgactccatgccctcctcccccatgcagactgcagggagggctgccaggtggagcgggggcgtcccagtgcatggagcagcaggcagtgagagcggagtctccggttgcctttccatgtaactggagcccatgtgtgattctgcatctctgccagtcagaatctcagggtcctcttgagatacaccaccatggctataagggttgggctcctgggcttttcaggtttgtaaagcaatctgag

SEQ ID NO: 451343 - DNA, 346 bp, Homo sapiens
acaggatctgtaccacatcatgttctggtcatctctcaggcacgcctgtaacagtgatacatgattcctgccaatggaatgcatttaaactgatcagcaacactgtagaaatgcctttatgctcggaagagggagagtggcttagaatttagatatgcatagtaaatgtttgagagaatcagcatagttagcttccatgcagttgtgttcatgttagaagaaagtgacattagccaactaatggcatcccctataacctcccaaggtttggcgatacgtctttacaagaagtcatcaacgtggagagtttggtgcggttaaattcctactttgagcagtttaagga

SEQ ID NO: 451344 - DNA, 6389 bp, Homo sapiens
cccggcgtctagagcggcggcggctggctagggctgcggcgcgcgtggagggttcgctgctggtttgccgccgggtcgggctccgtgggccggggcaggaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatggaaagtgtctttattttttagggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagatattaaatgtggtcttgcctgattcatcctattaggaggactagttctatgtgaccagcctgtgactggaccattgttcttgggcattgcattgagtgctcgggtgctgaatacatgtttgtaaacatgggaccatgggagacttccattttataagcttgtttctgcctaatttgaagcagaggggcaacagcgttgaggttaagagcacggactttgggagcacacagaccaggtcccaatcctggttctgcccctgactggctggtgactctgagcaagttgcttgacctctccaagcctccgtttcctcatgtgcaaagtgtggacaacaacagtaccttcctcataaggaacgtgcgacgcgcctcagaagtacgtgttcataaatggtagccattgttgttaccttcccgtctgtgaacatggatcacatcatctctgtgggtaacccagtcctcgttgtatgacttgtcaaaatgcagttccacttgtattaatattgaccctgttcatcgtcaccaggactgcatcttgcaccactgtgccgtcttctaggcacacacgacccgttatctcccttggaaaaattcctctcactggaaatgtacaattaaaggatgattgaaatgttta

SEQ ID NO: 451345 - DNA, 5755 bp, Homo sapiens
cccggcgtctagagcggcggcggctggctagggctgcggcgcgcgtggagggttcgctgctggtttgccgccgggtcgggctccgtgggccggggcaggaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtaccctctagtgtcatatatgaattcttcaagaagacctgaaggattggtttttattttttgtggtttttttaaaaaaaacatttcactaaagagtctctggagcatgttttttgttttttgggtttttttccccattggaatcaataggaggtaatgtttggctcaatagtgtggatagtaacaactgcctatttaaattaaatagcctttggctgtaactacacagatctcatcaatagttacctacatgaatcaagctaggtttgtctgaaatgctagaagactttttcaaatgcctgcttgctcacttacttttctacagagtaactcaaaagtaaccattgaattacaatccactttgtaaaaatctgaatgtaaaacagtaaataataaattaaataattggatcctaggcataccaataaatgttatttggggaaagaagctagcactatctcatgcagtgagaataacgggttctagtgaattatcctatctacactaccacctgaagaagttgaaagaaagattgataaatcaacgggagataagactttattagaaggtaacacctgcaaggtaccccacatagttggggccactcttttttctgtcccttatgagttacagaacagggagtctgctggagacacaaagccagcagtaaggtccctttagcctgtctcctgttctctgaagctccctgccgaggctccctcacgcccagaggacacatctccccttcttctctagatgttaatgtagggcctcagatgtggcatgtcaacactcccatggggaatttatgaccatagagatagtagaaacctaaatattttcagaaaaaaaattttttttgcaggatttccaatttatctttgaaaagacagtacaatcatgtttgaatgtctgatggaaagtgtctttattttttagggtttgcaataattgttactttcttattctcattcttatgtaagatgactattgagaaacagttgaaatttattctcctcaaatgagattttgaaagggatttatgggccataaaacttaggaatttcatagaaaattttgtctggtcatcttttataagatgatgatgagtcttatctgcacatagcagagtttgtttcttaggagtttatatgttttattgattctgtttacgatgtttacatgttcttgaaaaggttgtaaaagaaatacatatggcacatattaatgatgctgatcctaatgatttgtgaacctcttagaaattcttttgtctaaaagcctagagattcttctggttcctttagaaacatgtaacaaacttgggccaggggtgctgaggcatggggaggactgcttattggcaggaacacagagggggtgggcatcaggtagggtggaactggatgaccttccagaccccctcctactcagaagtcagcatgcaagcagcgcctgctgtctcccgatgcctgcagggaggaaaatgtctgtgaaggacactttaatgaaggacgaagctctctgctgctccctcaaagctgagttcactgtggcaggcaggaagcagagaagctcctgcccgccaaacccactgcacaggtggctgctgctggtatcagattctcctttttaagtgtcaatttctgttcacagacagtttgttttcaatatggctgatttaccctttcacctctccaccatctcatttaatttgtaaatttttagttctgtcttttctcattttaacttttaaaaaatctccttgctttttaaaaataaatattacccacatagttttcagatcttttttgtctggagagcattaaatatctgcactcatcaaagggaatatagcaaatgttgatcatctgtcagcagttttgcatgtgacacctttatatgaattattttcccaatttttgctctatgtaatgggtcaccataaaactgtaagacttggcaaatgctatagaaaaggttcaggtttcagtattctctctgaaggcatcattcctgggcttccggcagcatcacacgcttccagtgcctgcagggtgagggtgtgtggcacagaggcaagcagctcctctcttctgtaggagctttgggttttcagaggtgcagggaaggcagttttacaggttaccgtaaaacagaggttccgtccagtgttccttatgatgcctccccatttaaaaagaaaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtattactatatatatataaacatacagttactgttttatatattcttaggtcattcaaagccatgtatgctgtaaatgtgctagtctttagaatgacacataataaataactgacaagata

SEQ ID NO: 451346 - DNA, 3388 bp, Homo sapiens
cccggcgtctagagcggcggcggctggctagggctgcggcgcgcgtggagggttcgctgctggtttgccgccgggtcgggctccgtgggccggggcaggaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattcctatgtgacatggctccttcccatgctgtcgtagtcactgacacaagatgtgtttggtggcatgcattgtgcacctcctggtaggacttgggggaatcacagaggcaggacccaccctcggccagtgaagatgctgcagctagggctctgcagccacagaactaagggaggaaccgagagctgcacagcactgtctacgagaattccctcttgagttcaacccagtgaatattccctgaggacctgctgtgtgtaaagtgctagaggatccgatggcgaatgaggggtggaccctaccttggagggaaagctggtcccagagtgccggcctctctgtgcaggcgctgccacagccactagggggcgccacgcgtcagaaggtcacggatgtgccagacactgggctgggctctacatacgtttccacgctgaatccacaacagccctatgggtcggtgataggatccatgtccagatgaagaaaggggtgcctggctctgaagcccatgtgcttggattgtggctgaagccgtcctgctaggagagagtgatgcagaacactccggggctgggccaagaa

SEQ ID NO: 451347 - DNA, 365 bp, Homo sapiens
gcccacggtagatttgcccacggtagatttgcccacggtagatttgcccacggtagatttgcccacggtagatttgcccacggtagatttgcccacggtagatttgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaata

SEQ ID NO: 451348 - DNA, 1543 bp, Homo sapiens
  misc_feature (821)..(821): n is a, c, g, or t
gtggctttttaaagttcataccatcagtggtatgatggtaagaattgatttatttttacatagaagtatatatgaccgaatgcaaaaactagagatttaacattcaatgttattgtgttaataatgctaatgaatttcagtctatttcagtggcttaaaatgtaagtttgctagcaatttaaacttgcttgttaatgtaactgaaaattttgttggtagtttcagtgttctgacatttatgagtgcatatgacactagatcatataattaagttttaaactaagctgctgaagaataaatacacacttatttttctcatgttttctagtctctttatcatatagccacatacatgaggtatatgggtgagattttcccctcccaattttaattttctgtcataacaagtaggaattagtggggggaaatatttctttattgactgaatttgtagctaaagtaaattttatttgaggaataactttgtcaaaaatacttgctgaccatagctgctttgttgtaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctaggctatcaagtactagctccaactgcctatncatgatcagactgggtgccttaggtgggttggcccctgggagcaaggactggccttgggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcattaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcaggtaagtttgtttttacgatgagtgtactctgctaagtggaagaggtatatgagtgtgtttaacattaaaataagcaataatagcatgtaggataggaaggacaggaataaagtattggactactggtttaatttgtaggaaaaaaaaatcctgcaaatcttttcaacactcaccaatgtttaactcactataggcagcctgttctttactcatatataatacatttcctttttcccctggctctaggaattgattactgtaatttttgttttagtagggtttatttgggtcaatatattattcactaattattagc

SEQ ID NO: 451349 - DNA, 633 bp, Homo sapiens
gcgttctagaggatccctgcaacgccgagcgccatacacttcttaagatcaggtcgtaatggaagatcacgatggagaagttgttgctgcacacgccgaaggccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggaccttcggcgtgtgcagcaacaacttcgtccatcgggatttgcggcggtctggaccctcggcgtgtgcagccaccacttcgtccataccgacatgcaacaacttcgtccacacggatctcaaaaattcgtccctccgactaatgtagtagaactt

SEQ ID NO: 451350 - DNA, 216 bp, Homo sapiens
acgaggatttcaagtgctactccacaaacagctctttcagaggactaatgcactaacagttcaacagttaactgcagctcaacagcagcaatatgcattagcagcagctcagcagccacatataggtgagtcttcatacgttctcattttgaccaaagtcttgttaaaatgtctaggatgtttcacttttcgtttactgtttgtggaggtagcact

SEQ ID NO: 451351 - DNA, 6773 bp, Homo sapiens
cttggagtctgtctcacatatgtgcagttcaggcgtcatctgaaaatcccagtgtaatttatacacgggacatggcgtgtcctctctgggattccctttcttactttccagcagctctggttgctctagactgtgtcctttggtttcttcaggccattaaggctggattcttaaaggaatttaaggaccctacttccacatctaggccttccctcgggcagaaatgccatttaaaaaaaacaaacaaccaaacaaaaaaccttactctgtgctactcctttctttaaagtatagactgttctccagtttctgggctttaattgtttttcattgccttcacatagttgttggcacacagaataattcaagaacccttgacctaatgtttttctacaggttttaaggtagattgctgtcataaactgggaaaacctgtcttccctacagaaatcagtgcttccctttctcagatcatgctaatattagtcatagcagcaatataatataaaaatagttgaagaagtctgtttaaacatttctttgtactaatttttgtttttgttattcaacaggtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctcagttataacttaagattgattgcccattcaggtttactccgacgtaaagaaaacaaacatttttaacacatgggtgctgttctggagccactgat

SEQ ID NO: 451352 - DNA, 6413 bp, Homo sapiens
gggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcaagcttgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaaatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctcagttataacttaagattgattgcccattcaggtttactccgacgtaaagaaaacaaacatttttaacacatgggtgctgttctggagccactgat

SEQ ID NO: 451353 - DNA, 5369 bp, Homo sapiens
agtcttctctgttgttgagaataataaaagctcattattattattattattttttaaactactttgttaaagagcacaaatattagaaatagtttttaaccaaagattttctgtaacctccatgttgctttatagattgttctagctgttaagagctagtgattgtgtttttgatgttaatgtattttgtgatttttcatgctaaatctacatttccttgcatgtaaatgtttaaaaaatatccaaaggctgtttgtaataaatacacagttgtccaagataaatttacttatctattattttatattgattttaagaaaatcattttacctttgtaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctcagttataacttaagattgattgcccattcaggtttactccgacgtaaagaaaacaaacatttttaacacatgggtgctgttctggagccactgat

SEQ ID NO: 451354 - DNA, 6409 bp, Homo sapiens
gggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcaagcttgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctatgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctcagttataacttaagattgattgcccattcaggtttactccgacgtaaagaaaacaaacatttttaacacatgggtgctgttctggagccactgat

SEQ ID NO: 451355 - DNA, 4749 bp, Homo sapiens
gtggctttttaaagttcataccatcagtggtatgatggtaagaattgatttatttttacatagaagtatatatgaccgaatgcaaaaactagagatttaacattcaatgttattgtgttaataatgctaatgaatttcagtctatttcagtggcttaaaatgtaagtttgctagcaatttaaacttgcttgttaatgtaactgaaaattttgttggtagtttcagtgttctgacatttatgagtgcatatgacactagatcatataattaagttttaaactaagctgctgaagaataaatacacacttatttttctcatgttttctagtctctttatcatatagccacatacatgaggtatatgggtgagattttcccctcccaattttaattttctgtcataacaagtaggaattagtggggggaaatatttctttattgactgaatttgtagctaaagtaaattttatttgaggaataactttgtcaaaaatacttgctgaccatagctgctttgttgtaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctcagttataacttaagattgattgcccattcaggtttactccgacgtaaagaaaacaaacatttttaacacatgggtgctgttctggagccactgat

SEQ ID NO: 451356 - DNA, 3642 bp, Homo sapiens
gggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcaagcttgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaaggtaatacagcatgtaacactcagataactgtttgtctttgtgtttaggctacacatttaacctccttgggctttcatttcctcccgtatgttataactggaggaaaaattaaaatcgatggatatcctttggcagatatattggtatggtttccatttttatgcttaaggttatcatggccaggcatgggggcttttgcccataattccagcagattgggaggctgaggtgacaagatcacttgagcccaggagtttgagaccagcctgagcaatgtggcaagaccctccctctacaaa

SEQ ID NO: 451357 - DNA, 820 bp, Homo sapiens
gacctagaggatcccgactagtccaaccataccccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctcagttataacttaagattgattgcccattcaggtttactccgacgtaaagaaaacaaacatttttaacacatgggtgctgttctggagccactgat

SEQ ID NO: 451358 - DNA, 3257 bp, Homo sapiens
  misc_feature (2535)..(2535): n is a, c, g, or t
gggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcaagcttgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctaggctatcaagtactagctccaactgcctatncatgatcagactgggtgccttaggtgggttggcccctgggagcaaggactggccttgggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcattaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcaggtaagtttgtttttacgatgagtgtactctgctaagtggaagaggtatatgagtgtgtttaacattaaaataagcaataatagcatgtaggataggaaggacaggaataaagtattggactactggtttaatttgtaggaaaaaaaaatcctgcaaatcttttcaacactcaccaatgtttaactcactataggcagcctgttctttactcatatataatacatttcctttttcccctggctctaggaattgattactgtaatttttgttttagtagggtttatttgggtcaatatattattcactaattattagc

SEQ ID NO: 451359 - DNA, 1328 bp, Homo sapiens
gggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcaagcttgcggccgcagcagccctgtaagtcagtccgcgttcgctctttctccggtcctttggcgccgtcgaggatggctccccaggctttgtgcggcggcctcggcgggagccgatcgccagcgggagggcggatagggcctgctgagtgcccgggccggtgcggcctggggcccgctcgcacaatgcagggggaggggtgccggaagggggtgtgcgcgtgcgggggagggggcgccgcgccggccgctttcccgcttccttccctctgcggggccgccgcctcgggggcgtggggcgccgacccggttctccctccgattcggcgcgctggaggttagagaccgagctgtcggccctagggttcggaaagaggggagaggccgggtggccccagagaagcatgcggattgcaagtgggtgaagaggaaggagtgggtttatgaaaacaagtgtgggcattttcaaaggcccgagtgtgtccgggaaaagcttgccgtggacagatgtgggtatgaagcagtgacttggattcgccttgtttaggttataggaacggatttcgatattcagaaaaatatgtaaattaaaaccaaagacaagattagcggcttctactatttgagcagtagttttgtatctgaattgggtcaggttttggggaaaatgtttaaagtttcatgctcaaacacgtgtaaaagttagtgttgtttctgaaaacacagccagagaaaacctacttaacttagctttttattctaacatacgtaaacttttgaagagaggaatgtattgccagcatattaggtgcaataagacatcatgttaggacttagtactttgagatttttacttgttgagaaaacggggcagatgttttggtgaaggaaaacatgagaaaaatgcttgtaaacggtgaagagaaatgtaatacctgtaaaggtactgtatgtcaagaaaacaattttaataaagggagttaccgaaggattttaaaagcttgtttaatggttagatttcgtgtttaacaggtgactcttcaccatgtgacctggagtattggaagatgacttaaggaatcctgtaaata

SEQ ID NO: 451360 - DNA, 6463 bp, Homo sapiens
gggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcaagcttgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctcagttataacttaagattgattgcccattcaggtttactccgacgtaaagaaaacaaacatttttaacacatgggtgctgttctggagccactgat

SEQ ID NO: 451361 - DNA, 6084 bp, Homo sapiens
gggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcaagcttgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaata

SEQ ID NO: 451362 - DNA, 5146 bp, Homo sapiens
atgaacgaattctattcaaataccatagtacacacaccacgcagtccaaataatcacagacatctacaaagtcagtgagcagagacaatgagcagaaaagccggggcagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctcagttataacttaagattgattgcccattcaggtttactccgacgtaaagaaaacaaacatttttaacacatgggtgctgttctggagccactgat

SEQ ID NO: 451363 - DNA, 6410 bp, Homo sapiens
gggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcaagcttgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaatagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaataaaaatctgtacctcagttataacttaagattgattgcccattcaggtttactccgacgtaaagaaaacaaacatttttaacacatgggtgctgttctggagccactgat

SEQ ID NO: 451364 - DNA, 5196 bp, Homo sapiens
gggcgggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcaagcttgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctt

SEQ ID NO: 451365 - DNA, 1577 bp, Homo sapiens
acgtccggggaggggccaggtgagcggcagacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataatgcatttgttaggatggatgttttgaatcccaa

SEQ ID NO: 451366 - DNA, 2709 bp, Homo sapiens
gaggcgcccacaccaagatctctctcgccagttgttcgtctggcttccaggggacagcagaggccttggggacacgtccttggactgtgcatccctggacccagcagccctcatcccagctccgctcagtccaggcagaaaggccaagggttcttcacgttgcctctcccactggaacccagagccagcttgggcagctgtccccgtcccacaagggtcactcacctggtgcatggcaccgttcctctcaaggccagcagaaatcctacagagctggtcccgatgtctgctacctacgtatctgtttcagagactcacctgtcaagatgtgtccccataccactacgtctggcaagcccagctcctatagccagcttggatgctcttcctccaggaagccctccctgcctgaccctctgcaccctcttcttccttcgacgtggtgctgctattggaaggggtctccgtggatccccagacctgaccacaggcagagctggcctggccctgggtcctctgggccactgactgtggtgcaccctttcctcggaggctcagcctctgtctgcttggtggggggtcgatcacccctggccactgcccttatgatcctgctcagtgtcccacttccctgtcatgtgatggatgggcagctgtttggggctcagctgggtccccagtgcccagcatcagcgccagcacacagtaggtgttctgtgtttgttggaggggcagatagtgtgggggaaggagggaggaggtcggtgggtagaagaaatcaactgcttagccgggttgttaggaggatctgatgagactaggatgtgagttgaaactgctgtgccaggcacacctgtgtgggtctcacttgtgccaggcatacctgcgtgggtctcacctgtgtaggtctcacctgtgccaggtgtacctgtgtgggtcttacctgtgcaggtctcctgatgcaggtctcacctgtgccgagtgtacctacctgtgcgggtctcacctgtgtcaggcgtacgtgtaggggtctcacctgtgaacgtctcacctgtgccaggtgtatacctgtgtggctctcacttgtgtgggtctggtatgtgacaaaggcctgggaattggcagctgtcatctgccaggagcagaccctgagccaagttccctgtgccttaggctcatttcatgccctcagctctgggaggccaatccctttactgccacattttataaatggaagactgaggttaagcagtgggcccagggccatagaacagctgagctgtggagctggacatcgaccttgggcaggtgctgccaggggcctgagcccaggccctccactcccgcatcctctgatgacccatcctgggtgagtggaggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 451367 - DNA, 3020 bp, Homo sapiens
caggaaggggtgctctgtgggcttggaggatgcaggcgccttcctggggactgctctgtgagcagtgataaaatatttatcagccagcagctgggcttccctgcatagggtgcagtcgggggcagctcccacccgagcctgcagcctgagttctgctgagtcatgggggagcccagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagactcacctgtcaagatgtgtccccataccactacgtctggcaagcccagctcctatagccagcttggatgctcttcctccaggaagccctccctgcctgaccctctgcaccctcttcttccttcgacgtggtgctgctattggaaggggtctccgtggatccccagacctgaccacaggcagagctggcctggccctgggtcctctgggccactgactgtggtgcaccctttcctcggaggctcagcctctgtctgcttggtggggggtcgatcacccctggccactgcccttatgatcctgctcagtgtcccacttccctgtcatgtgatggatgggcagctgtttggggctcagctgggtccccagtgcccagcatcagcgccagcacacagtaggtgttctgtgtttgttggaggggcagatagtgtgggggaaggagggaggaggtcggtgggtagaagaaatcaactgcttagccgggttgttaggaggatctgatgagactaggatgtgagttgaaactgctgtgccaggcacacctgtgtgggtctcacttgtgccaggcatacctgcgtgggtctcacctgtgtaggtctcacctgtgccaggtgtacctgtgtgggtcttacctgtgcaggtctcctgatgcaggtctcacctgtgccgagtgtacctacctgtgcgggtctcacctgtgtcaggcgtacgtgtaggggtctcacctgtgaacgtctcacctgtgccaggtgtatacctgtgtggctctcacttgtgtgggtctggtatgtgacaaaggcctgggaattggcagctgtcatctgccaggagcagaccctgagccaagttccctgtgccttaggctcatttcatgccctcagctctgggaggccaatccctttactgccacattttataaatggaagactgaggttaagcagtgggcccagggccatagaacagctgagctgtggagctggacatcgaccttgggcaggtgctgccaggggcctgagcccaggccctccactcccgcatcctctgatgacccatcctgggtgagtggaggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 451368 - DNA, 1758 bp, Homo sapiens
acgtccggggaggggccaggtgagcggcagacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaaagacggggatctcactatgtggcccaggctggtctcgaactccaagctcaagcgatcctcccacctcagcctcccaaagtactgggattacaggtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataatgcatttgttaggatggatgttttgaatcccaa

SEQ ID NO: 451369 - DNA, 2431 bp, Homo sapiens
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataatgcatttgttaggatggatgttttgaatcccaa

SEQ ID NO: 451370 - DNA, 2216 bp, Homo sapiens
caggaaggggtgctctgtgggcttggaggatgcaggcgccttcctggggactgctctgtgagcagtgataaaatatttatcagccagcagctgggcttccctgcatagggtgcagtcgggggcagctcccacccgagcctgcagcctgagttctgctgagtcatgggggagcccagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataatgcatttgttaggatggatgttttgaatcccaa

SEQ ID NO: 451371 - DNA, 3819 bp, Homo sapiens
  misc_feature (3221)..(3221): n is a, c, g, or t
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgcgtagctgccctggcgcaggggtggggggcttggtcctcagatgctgtcccccagctactggcccagggtcaggctctggggtggccgaggtgacgtgtacccaccctcctcctgttgccatctggcactgcagggcaagagagggggttgttggggctgcccccaccatgcacagccagtccacactgtccaaaggcagaggaggtggggtcggtcagggttgtccaggccggtctctcaggcacagctgggccaggaggcagggtgatggggggctctctagatttggggctcatcatcctggtcaaagtcctgcctgtaaccgctcccaggccccagaccctcagctctctcatctagaaagggctctcggcatttctccccagatcattgtaggatgccaagcatatatcacaggaactgagcagctatagtgtctgatcctacaggcgctttgtgatgggtcaaatgctcagtgtggctgagcacagatgactcgtaaaaaactccgtaacagcatctcaaaacactggtgaatgctaaggaaagtgatgcctcgaaagaaccataaaacccctcaggccttcatctaagtcatcgaacaccgtcttttcaaatgggactacctccagcgccctcctttcttcttggagcactaacagtcgaaggggggagctgattttggtgtgaattctgaagcagctcggttaagatatcgtaaagacaaatcttgaatcttaaaatcaatgtttctaccccactgtgtattcaagaatcacatttgcccaaagggcagcctggcctttgtcctggcccctggggggtgacttctgaaccttgcactttcccaaggggcaggagttacctttgtcactcatcaggggccctgatggtttatggtaactcatggttatggtgtgactcaagataggggtgtaggggtggccattccagaaagaccaattacatggttagagggtgcgggctttgagtgatgtgagaccagcctgacctctggggagggcatggggctggagactgatttcagtctcaaggcgtcctgtcaaggtcgctggaccccaaactcccctcaaaggcaaatttacacccatttactcagcagtgctcctaagcgcctgccaaatgcaacgccctttctgagatggggaaggtctctcctacaccctggaagaccatgaaagatgttgagggctgactgactttggctagtggatgggaagcctgggagagttcagagccaggctgagcctcatggagacaaatttgatcatgcgcatagnggtacctatctggtggagacagaaggaggcactacattcagcagcatcctaccagccggggccagagcaggcaagatggacaatgctccatcacctgaatgcgccaggctgtgtcctagagagaagcttccagaagcctcccaacttcattagcccctgcagagggatgatgactccagcctctgtaggttcctgcttgagaaaactcaatgctgccaggcgaacttactgtttgttccagccaaaacctggtgacagggagataggccctggaacccctctttgagcagcagttcctttagaaagcttgcaattgtgggccaggcatggtggctcgcgcctgtaatcccagcactttgggaggctgagttgggtggatcacttgtcataggagttcaggaccagcctggtcaacatggcaaaaccctgtctctactaaaatacaaaaattagccaagcgtggtggtgcacgcctgtggtcccagctactcgggaggctgaggcgggagaatgacttgaacccaggaggcagaggttgtagtgagccgggatcgtgccattgcactgcagcctgggtgacagaacaagactccatctc

SEQ ID NO: 451372 - DNA, 2096 bp, Homo sapiens
caggaaggggtgctctgtgggcttggaggatgcaggcgccttcctggggactgctctgtgagcagtgataaaatatttatcagccagcagctgggcttccctgcatagggtgcagtcgggggcagctcccacccgagcctgcagcctgagttctgctgagtcatgggggagcccagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctggaaaaaaaaaaaaaaacgagtgatcgccattagacttccaggtttaccagctgcaccacttcctcctcataggaaaaaaa

SEQ ID NO: 451373 - DNA, 1420 bp, Homo sapiens
tctagagatcccggcactgttcggatggcgcctcccacgagctggccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataatgcatttgttaggatggatgttttgaatcccaa

SEQ ID NO: 451374 - DNA, 2308 bp, Homo sapiens
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggtatttgaagtacacactggaccaatacgttgagaacgattataccatcgtctatttccactacgggctgaacagccggaacaagccttccctgggctggctccagagcgcatacaaggagttcgataggaaagacggggatctcactatgtggcccaggctggtctcgaactccaagctcaagcgatcctcccacctcagcctcccaaagtactgggattacaggtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaagccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataatgcatttgttaggatggatgttttgaatcccaa

SEQ ID NO: 451375 - DNA, 1189 bp, Homo sapiens
ctccgcggccccctcccccggccccgggctccggctccggctccggctctggctctgcgcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 451376 - DNA, 1911 bp, Homo sapiens
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtaagtgcctgttagaccccagaagccgcatcaatacatcttcgtgcttccaaagggcttggttcagtcccatgaatgtttaaggcttgatttccaaatgtgtgcttggctagatttggctcagaaatctgcggcatcgacaaagatccgcagcaaaaggtgctaactgctgactcagagaaatgaaatggcaaaggttgtatacaggacgggatgttttcctcgcccaccattgcaaaactgatttaaaaaataagccctaacatggcaacggccgtttgttgccttggtgtttaccgtttttgcttttgagcagaaaattaggagaatttcccaggcgtgtggataacgctgtgtacagaatgaagtgttctcagggacgtcacg

SEQ ID NO: 451377 - DNA, 1878 bp, Homo sapiens
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 451378 - DNA, 3137 bp, Homo sapiens
caggaaggggtgctctgtgggcttggaggatgcaggcgccttcctggggactgctctgtgagcagtgataaaatatttatcagccagcagctgggcttccctgcatagggtgcagtcgggggcagctcccacccgagcctgcagcctgagttctgctgagtcatgggggagcccagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagactcacctgtcaagatgtgtccccataccactacgtctggcaagcccagctcctatagccagcttggatgctcttcctccaggaagccctccctgcctgaccctctgcaccctcttcttccttcgacgtggtgctgctattggaaggggtctccgtggatccccagacctgaccacaggcagagctggcctggccctgggtcctctgggccactgactgtggtgcaccctttcctcggaggctcagcctctgtctgcttggtggggggtcgatcacccctggccactgcccttatgatcctgctcagtgtcccacttccctgtcatgtgatggatgggcagctgtttggggctcagctgggtccccagtgcccagcatcagcgccagcacacagtaggtgttctgtgtttgttggaggggcagatagtgtgggggaaggagggaggaggtcggtgggtagaagaaatcaactgcttagccgggttgttaggaggatctgatgagactaggatgtgagttgaaactgctgtgccaggcacacctgtgtgggtctcacttgtgccaggcatacctgcgtgggtctcacctgtgtaggtctcacctgtgccaggtgtacctgtgtgggtcttacctgtgcaggtctcctgatgcaggtctcacctgtgccgagtgtacctacctgtgcgggtctcacctgtgtcaggcgtacgtgtaggggtctcacctgtgaacgtctcacctgtgccaggtgtatacctgtgtggctctcacttgtgtgggtctggtatgtgacaaaggcctgggaattggcagctgtcatctgccaggagcagaccctgagccaagttccctgtgccttaggctcatttcatgccctcagctctgggaggccaatccctttactgccacattttataaatggaagactgaggttaagcagtgggcccagggccatagaacagctgagctgtggagctggacatcgaccttgggcaggtgctgccaggggcctgagcccaggccctccactcccgcatcctctgatgacccatcctgggtgagtggaggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 451379 - DNA, 2998 bp, Homo sapiens
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagactcacctgtcaagatgtgtccccataccactacgtctggcaagcccagctcctatagccagcttggatgctcttcctccaggaagccctccctgcctgaccctctgcaccctcttcttccttcgacgtggtgctgctattggaaggggtctccgtggatccccagacctgaccacaggcagagctggcctggccctgggtcctctgggccactgactgtggtgcaccctttcctcggaggctcagcctctgtctgcttggtggggggtcgatcacccctggccactgcccttatgatcctgctcagtgtcccacttccctgtcatgtgatggatgggcagctgtttggggctcagctgggtccccagtgcccagcatcagcgccagcacacagtaggtgttctgtgtttgttggaggggcagatagtgtgggggaaggagggaggaggtcggtgggtagaagaaatcaactgcttagccgggttgttaggaggatctgatgagactaggatgtgagttgaaactgctgtgccaggcacacctgtgtgggtctcacttgtgccaggcatacctgcgtgggtctcacctgtgtaggtctcacctgtgccaggtgtacctgtgtgggtcttacctgtgcaggtctcctgatgcaggtctcacctgtgccgagtgtacctacctgtgcgggtctcacctgtgtcaggcgtacgtgtaggggtctcacctgtgaacgtctcacctgtgccaggtgtatacctgtgtggctctcacttgtgtgggtctggtatgtgacaaaggcctgggaattggcagctgtcatctgccaggagcagaccctgagccaagttccctgtgccttaggctcatttcatgccctcagctctgggaggccaatccctttactgccacattttataaatggaagactgaggttaagcagtgggcccagggccatagaacagctgagctgtggagctggacatcgaccttgggcaggtgctgccaggggcctgagcccaggccctccactcccgcatcctctgatgacccatcctgggtgagtggaggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctgg

SEQ ID NO: 451380 - DNA, 1853 bp, Homo sapiens
acgtccggggaggggccaggtgagcggcagacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaaagacggggatctcactatgtggcccaggctggtctcgaactccaagctcaagcgatcctcccacctcagcctcccaaagtactgggattacaggtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctgctcaaaaaaaaaaaaaaaatagaaaagaaaaaaacaaaagaaaaaaagcgaatagaaaacaaaacaagagaaagaatcaaaaaaaaaaggaggggggggggcggggacacagatccccctccggggggggcgaccgtttccgtccgccaccccgttttttgggccaggagggggccctc

SEQ ID NO: 451381 - DNA, 1756 bp, Homo sapiens
ctccgcggccccctcccccggccccgggctccggctccggctccggctctggctctgcgcggtggcagcggcggcggcggcgcggggaccgaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtgaggcctcacagctggccttgagtttttactgacacgtccctgtgtgcgggggtgtccatgtggcgtgtgtgtgagtgagacttttttactgcgtcccgtcccgccagccctatcggcctcgtcactggccttggtcactttgtatttctgtcttggttggaaataccatcagccttccttgctcggcccaggtctgtttcaggcatctgagtcggcgtttacccaggggccgggccagagacgggggtcggccgctcgctcccacgctcctcctgccccagccctctggtgtccacacctgcccacagagaatgtaaacccagtgggctctgcccacgccgggccccaaagtgaccagactccagcacacctgtctcctcctgcctggggtggccatggggatggaagggggtggaataaaacctgtcaacctggaaaaaaaaaaaaaaacgagtgatcgccattagacttccaggtttaccagctgcaccacttcctcctcataggaaaaaaa

SEQ ID NO: 451382 - DNA, 2921 bp, Homo sapiens
  misc_feature (2323)..(2323): n is a, c, g, or t
acgtccggggaggggccaggtgagcggcagacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgcgtagctgccctggcgcaggggtggggggcttggtcctcagatgctgtcccccagctactggcccagggtcaggctctggggtggccgaggtgacgtgtacccaccctcctcctgttgccatctggcactgcagggcaagagagggggttgttggggctgcccccaccatgcacagccagtccacactgtccaaaggcagaggaggtggggtcggtcagggttgtccaggccggtctctcaggcacagctgggccaggaggcagggtgatggggggctctctagatttggggctcatcatcctggtcaaagtcctgcctgtaaccgctcccaggccccagaccctcagctctctcatctagaaagggctctcggcatttctccccagatcattgtaggatgccaagcatatatcacaggaactgagcagctatagtgtctgatcctacaggcgctttgtgatgggtcaaatgctcagtgtggctgagcacagatgactcgtaaaaaactccgtaacagcatctcaaaacactggtgaatgctaaggaaagtgatgcctcgaaagaaccataaaacccctcaggccttcatctaagtcatcgaacaccgtcttttcaaatgggactacctccagcgccctcctttcttcttggagcactaacagtcgaaggggggagctgattttggtgtgaattctgaagcagctcggttaagatatcgtaaagacaaatcttgaatcttaaaatcaatgtttctaccccactgtgtattcaagaatcacatttgcccaaagggcagcctggcctttgtcctggcccctggggggtgacttctgaaccttgcactttcccaaggggcaggagttacctttgtcactcatcaggggccctgatggtttatggtaactcatggttatggtgtgactcaagataggggtgtaggggtggccattccagaaagaccaattacatggttagagggtgcgggctttgagtgatgtgagaccagcctgacctctggggagggcatggggctggagactgatttcagtctcaaggcgtcctgtcaaggtcgctggaccccaaactcccctcaaaggcaaatttacacccatttactcagcagtgctcctaagcgcctgccaaatgcaacgccctttctgagatggggaaggtctctcctacaccctggaagaccatgaaagatgttgagggctgactgactttggctagtggatgggaagcctgggagagttcagagccaggctgagcctcatggagacaaatttgatcatgcgcatagnggtacctatctggtggagacagaaggaggcactacattcagcagcatcctaccagccggggccagagcaggcaagatggacaatgctccatcacctgaatgcgccaggctgtgtcctagagagaagcttccagaagcctcccaacttcattagcccctgcagagggatgatgactccagcctctgtaggttcctgcttgagaaaactcaatgctgccaggcgaacttactgtttgttccagccaaaacctggtgacagggagataggccctggaacccctctttgagcagcagttcctttagaaagcttgcaattgtgggccaggcatggtggctcgcgcctgtaatcccagcactttgggaggctgagttgggtggatcacttgtcataggagttcaggaccagcctggtcaacatggcaaaaccctgtctctactaaaatacaaaaattagccaagcgtggtggtgcacgcctgtggtcccagctactcgggaggctgaggcgggagaatgacttgaacccaggaggcagaggttgtagtgagccgggatcgtgccattgcactgcagcctgggtgacagaacaagactccatctc

SEQ ID NO: 451383 - DNA, 1703 bp, Homo sapiens
cctgctgggcctcggttttctatctgtaaagtggggggattatttccagcgtacggctggtcatgaagatgaacttggaccacgtgcataaagccacaggtgatggatgctcactcagcaggtgtcgcctccgaggaacgctgctgcctgtgcctcccagctcgggctggactggccaaggaggctgctttttgctaagtgcctgaggattttctaggagaaggtggcacagaggctcacctgtgtctgctcctccaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataatgcatttgttaggatggatgttttgaatcccaa

SEQ ID NO: 451384 - DNA, 1387 bp, Homo sapiens
atgtccgtggctgtgttccaagaaaacgttattggcaaaaacaggcagtgggccagatctaagccatgggcggtagtttgccaacccctggtctagaccactcccatttataaagtgattcggctttagcagcttcctggaaggtggtgctgctggctgataaagcagagggatggagcttgtagaattcaggtgatgatagggcttggatctgagtccccagcgcgtctcatgttgaattgaaactttggaggtggggactggtggcaggtgattggatcatgagggcagatacctcatgggttggtgctgtcctcgagatagtgagttcttaccagatctggtttaaaagcatgtggcacctctgtcccactctctcttgctcctgtttttgccacgtgatgcacctccttcctttttgccttctgccataattggaagcctcctgaggcttctccagaagctgaacaggtgctggtgccatgcttgtacagcctgtagaaccatgagccagttaaacctcttttcttataaataaccccatctcagcaagaatagccaaacacacaggtttgctgagcagagccatacggccagaagataagtgggggtcccaagcccaaatgtgggatagtccatcctcagagctgtccttcctccacccgttctcctcccgggccgggatgcagcgctgcccctggcccctctggagctcagcagggagccccatgcccttccaggtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataatgcatttgttaggatggatgttttgaatcccaa

SEQ ID NO: 451385 - DNA, 1787 bp, Homo sapiens
caggaaggggtgctctgtgggcttggaggatgcaggcgccttcctggggactgctctgtgagcagtgataaaatatttatcagccagcagctgggcttccctgcatagggtgcagtcgggggcagctcccacccgagcctgcagcctgagttctgctgagtcatgggggagcccagtgagccgcctgccctcaagctcctgggccccctctgccctttggccatgtgaacgcctcctaatgtgtaagccattcggctgcccccaaggccaggcatccagtgtgcttagtgctgagcagggtttcagagctcacccccaggagggtgcagacctcagccaaggtcgcagagcagaggagacccgtgggctgggattccacctgtgcccaccctggcagcatcccacctcctgagtcctctcggcacccagcaagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaaagacggggatctcactatgtggcccaggctggtctcgaactccaagctcaagcgatcctcccacctcagcctcccaaagtactgggattacaggcaggagccaccatgccaagccaacactcttgttcttaaagggccagacagtcagcattttagctttgcaggcctgttgctctattgcaacaactctgctggactgtgttccagtaaaacattatggacgctgaaatgtgaatttcatgtcattttcacgtgtcatgaaatattcttctgtttttttttttcaaccacttaaaaacataaaaagccatttttagcttgcagcctgtaccaaagcaggaagcaggctaggttcatcctgcctgcccattctcccacccctggtccagtgaattactggcaaagaaacaactgcatgaccgtttcttcactaaagcctcttcttgctttcacagccctttacagtctgcaaggggcattctgatgcctcttgttggtgagatggcagcctcattttacagatgaggacataggccccagggagcaagtgacttacccgtggtcactcagcttgtgtgtggtagggcaggatcccaccccaggcccccgcctccctctcccacccaacgctactcaccgcttggccatggcctggagccggcagacttttcctgagggacgtccggcctaataatcaacttggcaatatatctggctcgtagactgcggcgatgggcgttgatgtggatatcctagattcctctgggttttccttcttcaaagtcctttcaaacct

SEQ ID NO: 451386 - DNA, 1709 bp, Homo sapiens
gcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacgtgcccgcaagccttcagggacgtgggtgtgggctgcttgtggcaggaggaggcattgtggccacaaggggtcgcagagtgtgcagtgggggaggggtctggtagggcggagggtggagggtgagcaaatgtggggcagtggaggttcacctcccctctgggccaagctctggaatcccgggcaggggttggcactcatttttttttttctttctttcttttttttaagagacggtctcacccagccaccatggctcacacctgtaatcccagtactttgggaggccaaggtgggtggatcacctgaggtcaggagttcgagaccaggctggccaacatggcgaaaccctgtctctagtaaaaatac

SEQ ID NO: 451387 - DNA, 1031 bp, Homo sapiens
  misc_feature (804)..(804): n is a, c, g, or t
  misc_feature (822)..(822): n is a, c, g, or t
  misc_feature (827)..(827): n is a, c, g, or t
  misc_feature (830)..(830): n is a, c, g, or t
  misc_feature (835)..(835): n is a, c, g, or t
  misc_feature (837)..(837): n is a, c, g, or t
  misc_feature (1029)..(1030): n is a, c, g, or t
aattcgcggccgcgtcgaccgacagaaggggaccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaattggnctggccgtcccaagggtncttgnctntcagngnaaaatggcgcttcgggggccaggcggcggataatggtcccgccatggggttctaagagcgccaaatcggggatggggccactcggggcgaggacaaggtgaagctaccgactgttcacaccgctgggtagtgtccccagaatctggccgtgtgggcccagcacagtatgcccctttctgcgctccttctccnnc

SEQ ID NO: 451388 - DNA, 2125 bp, Homo sapiens
agaaatttctcagcctcctacttctgcttttgaaagctataaaaacagcgagggagaaactggcagataccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaaggtagttagccaagagcaggcagtagatctccacttgtgtcctcttggaagtcatcaagccccagccaactcaattcccccagagccaaagccctttaaaggtagaaggcccagcggggagacaaaacaaagaaggctggaaaccaaagcaatcatctctttagtggaaactattcttaaagaagatcttgatggctactgacatttgcaactccctcactctttctcaggggcctttcacttacattgtcaccagaggttcgtaacctccctgtgggctagtgttatgaccatcaccattttacctaagtagctctgttgctcggccacagtgagcagtaatagacctgaagctggaacccatgtctaatagtgtcaggtccagtgttcttagccaccccaatcccagcttcatccctactggtgttgtcatcagactttgaccgtatatgctcaggtgtcctccaagaaatcaaattttgccgcctcgcctcacgaggcctgcccttctgattttatacctaaacaacatgtgctccacatttcagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaaggg

SEQ ID NO: 451389 - DNA, 1068 bp, Homo sapiens
  misc_feature (841)..(841): n is a, c, g, or t
  misc_feature (859)..(859): n is a, c, g, or t
  misc_feature (864)..(864): n is a, c, g, or t
  misc_feature (867)..(867): n is a, c, g, or t
  misc_feature (872)..(872): n is a, c, g, or t
  misc_feature (874)..(874): n is a, c, g, or t
  misc_feature (1066)..(1067): n is a, c, g, or t
agaaatttctcagcctcctacttctgcttttgaaagctataaaaacagcgagggagaaactggcagataccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaattggnctggccgtcccaagggtncttgnctntcagngnaaaatggcgcttcgggggccaggcggcggataatggtcccgccatggggttctaagagcgccaaatcggggatggggccactcggggcgaggacaaggtgaagctaccgactgttcacaccgctgggtagtgtccccagaatctggccgtgtgggcccagcacagtatgcccctttctgcgctccttctccnnc

SEQ ID NO: 451390 - DNA, 1791 bp, Homo sapiens
cttgccccaacatccgtcccacccaatgccaggtggttccttgtagggaaattttaccgcccagcaggaacttatatctctccgctgtaacgggcaaaagtttcaagtgcggtgaacccatcattagctgtggtgatctgcctggcatcgtgccacagtagccaaagcctctgcacaggagtgtgggcaactaaggctgctgactttgaaggacagcctcactcagggggaagctatttgctctcagccaggccaagaaaatcctgtttctttggaatcgggtagtaagagtgatcccagggcctccaattgacactgctgtgactgaggaagatcaaaatgagtgtctctctttggagccactttcccagctcagcctctcctctcccagtttcttcccatgggctactctctgttcctgaaacagttctggtgcctgatttctggcagaagtacagcttcacctctttcctttccttccacattgatcaagttgttccgctcctgtggatgggcacattgccagccagtgacacaatggcttccttccttccttccttcagcatttaaaatgtagaccctctttcattctccgttcctactgctatgaggctctgagaaaccctcaggcctttgaggggaaaccctaaatcaacaaaatgaccctgctattgtctgtgagaagtcaagttatcctgtgtcttaggccaaggaacctcactgtgggttcccacagaggctaccaaattacatgtatcctactcatggggcctaggggttggggtgaccctgcactgctgtgtccctaaccacaagacccccttctttcttcagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaaggg

SEQ ID NO: 451391 - DNA, 308 bp, Homo sapiens
  misc_feature (288)..(288): n is a, c, g, or t
aattcgcggccgcgtcgaccgacagaaggggaccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctctctagacctgacctctgcctctgatgcgcatcagctcgatctcgacacactacagcagctagcagngtcagtgtgtgcatgcagct

SEQ ID NO: 451392 - DNA, 852 bp, Homo sapiens
ggcacaaggcacaacaggctgctctgggattctcttcagccaatcttcattgctcaagtatgactttaatcttccttacaactaggtgctaagggagtctctctgtctctctgcctctttgtgtgtatgcatattctctctctctctctctttctttctctgtctctccctctccttccctctctgcctccctctctcagctttttgcaaaaatgccaggtgtaatataatgcttatgactcgggaaatattctgggaatggatactgcttatctaacagctgacaccctaaaggttagtgtcaaagcctctgctccagctctcctagccaatacattgctagttggggtttggtttagcaaatgcttttctctagacccaaaggacttctctttcacacattcattcatttactcagagatcatttctttgcatgactgccatgcactggatgctgagagaaatcacacatgaacgtagccgtcatggggaagtcactcattttctcctttttacacaggtgtctgaagcagccatggcagaagtacctgagctcgccagtgaaatgatggcttattacaggtcagtggagacgctgagaccagtaacatgagcaggtctcctctttcaagagtagagtgttatctgtgcttggagaccagatttttcccctaaattgcctctttcagtggcaaacagggtgccaagtaaatctgatttaaagactactttcccattacaagtccctccagccttgggacctggaggctatccagatgtgttgttgcaagggcttcctgcagaggcaaatggggagaaaagactccaagcccacaatacaaggaatccctt

SEQ ID NO: 451393 - DNA, 1578 bp, Homo sapiens
agaaatttctcagcctcctacttctgcttttgaaagctataaaaacagcgagggagaaactggcagataccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaaggg

SEQ ID NO: 451394 - DNA, 1541 bp, Homo sapiens
aattcgcggccgcgtcgaccgacagaaggggaccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaaggg

SEQ ID NO: 451395 - DNA, 2004 bp, Homo sapiens
aattcgcggccgcgtcgaccgacagaaggggaccaaacctcttcgaggcacaaggcacaacaggctgctctgggattctcttcagccaatcttcattgctcaagtatgactttaatcttccttacaactaggtgctaagggagtctctctgtctctctgcctctttgtgtgtatgcatattctctctctctctctctttctttctctgtctctccctctccttccctctctgcctccctctctcagctttttgcaaaaatgccaggtgtaatataatgcttatgactcgggaaatattctgggaatggatactgcttatctaacagctgacaccctaaaggttagtgtcaaagcctctgctccagctctcctagccaatacattgctagttggggtttggtttagcaaatgcttttctctagacccaaaggacttctctttcacacattcattcatttactcagagatcatttctttgcatgactgccatgcactggatgctgagagaaatcacacatgaacgtagccgtcatggggaagtcactcattttctcctttttacacaggtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaaggg

SEQ ID NO: 451396 - DNA, 1304 bp, Homo sapiens
agaaatttctcagcctcctacttctgcttttgaaagctataaaaacagcgagggagaaactggcagataccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaaggtagttagccaagagcaggcagtagatctccacttgtgtcctcttggaagtcatcaagccccagccaactcaattcccccagagccaaagccctttaaaggtagaaggcccagcggggagacaaaacaaagaaggctggaaaccaaagcaatcatctctttagtggaaactattcttaaagaagatcttgatggctactgacatttgcaactccctcactctttctcaggggcctttcacttacattgtcaccagaggttcgtaacctccctgtgggctagtgttatgaccatcaccattttacctaagtagctctgttgctcggccacagtgagcagtaatagacctgaagctggaacccatgtctaatagtgtcaggtccagtgttcttagccaccccaatcccagcttcatccctactggtgttgtcatcagactttgaccgtatatgctcaggtgtcctccaagaaatcaaattttgccgcctcgcctcacgaggcctgcccttctgattttatacctaaacaacatgtgctccacatttcagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaaggtaaatggaaacatcctggtttccctgcctggcctcctggcagcttgctaattctccatgttttaaacaaagtagaaagttaatttaaggcaaatgatcaacacaagtgaaaaaaaatattaaaaaggaatataca

SEQ ID NO: 451397 - DNA, 897 bp, Homo sapiens
caacctttctttccccagtgtcctaaaagtatgaggatctcctgtttcaaagctgaacaaggcaatatgggagaaaatttgacaagaaacctcacagttgtaattaacctctggtgattctattttattttttcttttcttgaagccttgaagattttgatatctttatctgctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaatgctttggaggtttggcgtttctacaaagatcgggcgggttgagggcaaccttgctccagagcgttggcgtgacagtttaatcttctcaccgtgtacgtggcccggggcccttttggggggcgtgg

SEQ ID NO: 451398 - DNA, 1398 bp, Homo sapiens
caacctttctttccccagtgtcctaaaagtatgaggatctcctgtttcaaagctgaacaaggcaatatgggagaaaatttgacaagaaacctcacagttgtaattaacctctgctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaacaaattattttgtgaatctgtttcactcaatggattgtaaagaaggctcctaaatttgagttgtttgctaatcatttcatttgcatcattagggtatccttaaactgattttctattacaattggaagtggagaatatgtgcatctacactaaaaaaatgtttaagatatcaaaaacctctcctcgtgcttcaaaatgacaggaatcctgtgcattatactaagaattacatgccataagatgacttcagaaatcctacttcagaagtgtaataaatggatggggaaatcgtttgatggggaaaagtctcttgtaagtaaaagtagtcaaattcaaatggcaaaatctc

SEQ ID NO: 451399 - DNA, 2110 bp, Homo sapiens
gcctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgtctagccatcctaagattaggacttcttcttgactgcccgagactcgccatttctgcccgtgaatttgtgtctgatcgctttgtacagatttgtaaggaagaggactttatgcaactgtctccacaggaactgatctcagtcatttcaaatgacagcctaaatgtagaaaaagaagaagcagtatttgaggcagtgatgaaatgggtgcgaacagacaaggaaaacagggttaaaaaccttagtgaagtgtttgattgtatccgttttcgccttatgacagaaaaatattttaaggatcatgttgagaaagatgatataattaaaagcaacccagacctccagaaaaaaatcaaagttctaaaagatgctttcgcaggcaaactcccagaacctagcaaaaatgccgcgaagactggggctggtgaggtgaatggtgatgttggtgatgaagatttacttcctggttacctgaatgacattcccaggcatggaatgtttgtaaaagacctcatcctcttggttaatgacacagcagcagtggcttatgaccccacggaaaatgaatgctaccttactgcactggctgagcagattcccagaaatcattccagcattgttacccagcaaaatcagatatatgtggtaggaggactatatgtggatgaagaaaataaggatcaacctctacagtcatacttcttccagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttggggggggacctggacccgactctcctttatagaaggtttaataaagttatcgtggccgagattaaccaacgggtgagatggcaaaacccgggggttccccaattaaatgacctggagaaaaatccccttttttcacagtt

SEQ ID NO: 451400 - DNA, 852 bp, Homo sapiens
ttcattccttccatttatttgttgtaggtcaaagcttcaactgaagctgaaagaccatcttcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaacaaattattttgtgaatctgtttcactcaatggattgtaaagaaggctcctaaatttgagttgtttgctaatcatttcatttgcatcattagggtatccttaaactgattttctattacaattggaagtggagaatatgtgcatctacactaaaaaaatgtttaagatatcaaaaacctctcctcgtgcttcaaaatgacaggaatcctgtgcattatactaagaattacatgccataagatgacttcagaaatcctacttcagaagtgtaataaatggatggggaaatcgtttgatggggaaaagtctcttgtaagtaaaagtagtcaaattcaaatggcaaaatctc

SEQ ID NO: 451401 - DNA, 2474 bp, Homo sapiens
gcctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgtctagccatcctaagattaggacttcttcttgactgcccgagactcgccatttctgcccgtgaatttgtgtctgatcgctttgtacagatttgtaaggaagaggactttatgcaactgtctccacaggaactgatctcagtcatttcaaatgacagcctaaatgtagaaaaagaagaagcagtatttgaggcagtgatgaaatgggtgcgaacagacaaggaaaacagggttaaaaaccttagtgaagtgtttgattgtatccgttttcgccttatgacagaaaaatattttaaggatcatgttgagaaagatgatataattaaaagcaacccagacctccagaaaaaaatcaaagttctaaaagatgctttcgcaggcaaactcccagaacctagcaaaaatgccgcgaagactggggctggtgaggtgaatggtgatgttggtgatgaagatttacttcctggttacctgaatgacattcccaggcatggaatgtttgtaaaagacctcatcctcttggttaatgacacagcagcagtggcttatgaccccacggaaaatgaatgctaccttactgcactggctgagcagattcccagaaatcattccagcattgttacccagcaaaatcagatatatgtggtaggaggactatatgtggatgaagaaaataaggatcaacctctacagtcatacttcttccagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaacaaattattttgtgaatctgtttcactcaatggattgtaaagaaggctcctaaatttgagttgtttgctaatcatttcatttgcatcattagggtatccttaaactgattttctattacaattggaagtggagaatatgtgcatctacactaaaaaaatgtttaagatatcaaaaacctctcctcgtgcttcaaaatgacaggaatcctgtgcattatactaagaattacatgccataagatgacttcagaaatcctacttcagaagtgtaataaatggatggggaaatcgtttgatggggaaaagtctcttgtaagtaaaagtagtcaaattcaaatggcaaaatctc

SEQ ID NO: 451402 - DNA, 2127 bp, Homo sapiens
gcctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgtctagccatcctaagattaggacttcttcttgactgcccgagactcgccatttctgcccgtgaatttgtgtctgatcgctttgtacagatttgtaaggaagaggactttatgcaactgtctccacaggaactgatctcagtcatttcaaatgacagcctaaatgtagaaaaagaagaagcagtatttgaggcagtgatgaaatgggtgcgaacagacaaggaaaacagggttaaaaaccttagtgaagtgtttgattgtatccgttttcgccttatgacagaaaaatattttaaggatcatgttgagaaagatgatataattaaaagcaacccagacctccagaaaaaaatcaaagttctaaaagatgctttcgcaggcaaactcccagaacctagcaaaaatgccgcgaagactggggctggtgaggtgaatggtgatgttggtgatgaagatttacttcctggttacctgaatgacattcccaggcatggaatgtttgtaaaagacctcatcctcttggttaatgacacagcagcagtggcttatgaccccacggaaaatgaatgctaccttactgcactggctgagcagattcccagaaatcattccagcattgttacccagcaaaatcagatatatgtggtaggaggactatatgtggatgaagaaaataaggatcaacctctacagtcatacttcttccagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaaca

SEQ ID NO: 451403 - DNA, 1992 bp, Homo sapiens
gcctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgtctagccatcctaagattaggacttcttcttgactgcccgagactcgccatttctgcccgtgaatttgtgtctgatcgctttgtacagatttgtaaggaagaggactttatgcaactgtctccacaggaactgatctcagtcatttcaaatgacagcctaaatgtagaaaaagaagaagcagtatttgaggcagtgatgaaatgggtgcgaacagacaaggaaaacagggttaaaaaccttagtgaagtgtttgattgtatccgttttcgccttatgacagaaaaatattttaaggatcatgttgagaaagatgatataattaaaagcaacccagacctccagaaaaaaatcaaagttctaaaagatgctttcgcaggcaaactcccagaacctagcaaaaatgccgcgaagactggggctggtgaggtgaatggtgatgttggtgatgaagatttacttcctggttacctgaatgacattcccaggcatggaatgtttgtaaaagacctcatcctcttggttaatgacacagcagcagtggcttatgaccccacggaaaatgaatgctaccttactgcactggctgagcagattcccagaaatcattccagcattgttacccagcaaaatcagatatatgtggtaggaggactatatgtggatgaagaaaataaggatcaacctctacagtcatacttcttccagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaaggagtccatgcctttggggagtctgagatcgtcacaagcatgcgtgcgctgttgcacggactaccgtttgcttcaggagctgttgccatcacccgtttaattctccaccgtctcacgggcccgggccccctctgtggggggggggggcgggggggccaatcctcggtccgcgtgcgccccctgttcccttctcgacccgggacc

SEQ ID NO: 451404 - DNA, 4373 bp, Homo sapiens
gaatgtggaggaaatcctgatgcaccaacaaggaagtttctgatcagataaggatttcaggacagttgcatgtgcaaaactattcgttgaggttccagaaacactgatatagagaccctcacagaagatacggtcccttatgcaccccactatgcttcactctttggggtgcagttagatattatgacttcagccaagcttcttggtaataaatgcattgacacactgacatatttagtaggttggggcaagtatttttagaagttttcatcctaagttcacaaccaccatgcaagctgccaggggccatgtgattcctgcccagaagttcagcttaggattgaaagtctggctggccttgactccctgggctctggtcatcagcaaatcatgagtttgggcaacaaaggtcaattccatctgatgctcatttttgtgaacaatttgcctccctcttagggagaaagattgctaaaataatttttgaaaattacctaatttttttgttgttcaaaacgttgaactcctcaatctaattatatcagagccaaagtatcctgtgaaaacaaagctttatatccaaaaatgtgcttttgcaaaattctttaatctgtgtaatggagggcagagggtatggggtaggagggtgggagaaagaaaagaaaagaatttggattctaatttatgaccatcttgacatatggtcaaaggtgtcattttcctactcagtttcaattctgagttaatttcttaagccttaaataataagaacaatggacagcctggcctggcagagagtttcacagatgacttaatctgagcaccatcacagagaagtcaggactaaaccccctactgagcagggcggcggagtgtccaaaggtctcagttctgtggagcagagtaccacgctttctgtggaatggggacagggtcaccacgctcactaaaatgcagtatgttccattgcagcaaagctttcgcctgtgttcaaaatgcatgtctagcagattgcagccttttaaattaaatatatataaatggttgtatatagaatatactctggactgtgagggcatcctattttggtatgcctcctggctgtggatggcatgtccagtgctctgtgagtgttttcagtcattcacattcactatgtgtttagagattctctccctgcttacagctgaaggatgttgatacaggcatcaagaaggctgaggggcagatggggcctgcaggttaaggcattgttaacttgctccatggaaatgtccatatcttaatgagtaaaaaagtgtatttttctgatacgtaaaccagaattgtgggcgtgtaggtcacatcactatttctttagcagcaaatctgttttcccagttgagagagacaatagcttctgcacaagaatatatgatggtaggatccatctgttcaattgtgtctgaaagaatctttattccaaagcgaaacctggggaaatgttttaccttcagccagatgctgtgtgtgtacttgggtcccttgtctttcctctaaggagaggtgcttgtggaaagtggaggttgtgggcatcttttcaaccttttcaatctgacctttcaacaggtcaggtgagagaaaagacaaagctatttgaacctatgtttttcttatgtccagaaatccgttctttcatcaaaccactaaaccactcgccttagcctcttctgcagtttctggtggctctatctgtgggcaagggactcctgcctgtgagaagtggccaggccctccagagcaacggggtctggcttcagggagcagtggggtgtggggaaagcaatgttcatcttggctgctccatttttataccatccatcaaggactcttgcgcttctctccacctgtgacgtagcagcattgccttctttcctcttggtgcttctgggcaaaactggaatttgaaatccagaactggcgttgtcttcttaaagagtatggttcctgcctcagttccagcctggtatggttctttgatatgccctgaaggttctcacatggaaacatcagtatcctgccattcatgttgttttaagatgttttaaaaaccaatggacaaacttcttgcttcaaggaacaaactcttaggttggcaacagcatataaaaaaaaagatcacagctgaatctcatgaaagattaaaaaccaaaggattcaagaccggtgttgtaaaatgaagaggaattttacttacatgttacagctgccaagtttttagatgttcctgtcatagctaaatagtcactgctagcctttcagagaacagatagtaacaattgtttgcagctgcagtgttgcatctaattttggtgtttaggctttttattttgtgggaagctttttgttaatatcctgcagggcaactgcctgttgggagggagaggatggaagaaggagcttactctgggggccttgcctattgagggaggctgttgcccagagcagttgcttcatggaagtcatccaaaggcgctctcagtcattacaatgacaggatctcaaagttgggaaagggctgttaagtcatccagtctagtctccacataggtgctgacattctgcctacaaccatcccaccaaggggttgagcagtctggacttaaacacctccgaggacagagaacccactacctcgtggagaagcctgttctttgtaaacctctggcttttctatgttctctgtaatttccatcttagtctctgccccatgggggccacatgggacaagttatttttggcaaagcacctaattgctggcactgtcccaaagcatagcgtttgccttttggaaagaaacaatgctaggacatggacactttggtacactgtccttacccctgagtattagtccactcagttccttgttggagaatgttgagaaaaccctactggctggcttgtttctgccaaagcttggggagaggagagggggatgagaagatgttagcagcctgctaaacctcagacagatgaggactcagttctgtgcttgccccacaaaaacggatgctcacatcatcaggaaattgttcagctggaggatttataacttcgttgctttgcatgaagtttaaagttttcatggttgcccagggcttgtaccttagattcctgtaaggactttgcactgtttttgctgagaaaacaacgcttcaggacttaaggtctaagcgtcagagaagtgccgtattttcaaggtggaaagtctgttaagcttgctgttgtccaatcatccgtttttagagatggggaaactaaaactcaaaaagatgtgcctgaggtcatatggcattatcagaaccaacctctggccctcttgacctgtctagcattctttctttctgacctataggatgactctaattcagtctaaatcggctgccctcagattcttgagaacttaaaattgagcagaaattcccaaggccaacctagctctcagggaccaacctgcagaactcaagattgagcgaaatgtttaggccagttgagttttgcaaaatgagtggtaagggaaaacagatctagcctgttatttaaaaccagggttcaaaagccctattgggagaggtagtattgtcctagcatttaaattctcatgaaatgtgcttggtctgtgatctcttggtcagatatctgccttccaggcgatcctttgaggttgtgtaattcagctggccctggctcctggtccctgttactgagctgggcagtcgaaccgaagggcagatgagctcaagatcatgccttgggaagcatggtgctctaggggtgcctttttattcctttcattgtattatagactgtttccaagtttatggttagaaatggtaaagtgggtctggtgttttgaggtagaacccagcctagggcaagatatgaactgttcttgaggtagaaatgtctacagtcagttgtttcatctagcttgcatcttaaaacacaaacccttcagttgctttcacttaatgcacacatttgccaatgacagagggttatacaggatccttcttttacatttctattgtctgctacgctcatcagagtatattttggggtacaaggttttgggggttttttttcccattttgtaactgccttattgaaaagtaagtgcccttccattccaggcctcctcatattgtacttgtttcctgccaaatctgggggatcatttgtattttaactttgtaatctatggctctgtactgttgaaaggctctcaattctgtggggtctccttagtatgtatgtgacttttcatgttgcaatatcacacgatgggatggcccgacttttgctcttaataaataatctgaatgagtaagaga

SEQ ID NO: 451405 - DNA, 4882 bp, Homo sapiens
gaatgtggaggaaatcctgatgcaccaacaaggaagtttctgatcagataaggatttcaggacagttgcatgtgcaaaactattcgttgaggttccagaaacactgatatagagaccctcacagaagatacggtcccttatgcaccccactatgcttcactctttggggtgcagttagatattatgacttcagccaagcttcttggtaataaatgcattgacacactgacatatttagtaggttggggcaagtatttttagaagttttcatcctaagttcacaaccaccatgcaagctgccaggggccatgtgattcctgcccagaagttcagcttaggattgaaagtctggctggccttgactccctgggctctggtcatcagcaaatcatgagtttgggcaacaaaggtcaattccatctgatgctcatttttgtgaacaatttgcctccctcttagggagaaagattgctaaaataatttttgaaaattacctaatttttttgttgttcaaaacgttgaactcctcaatctaattatatcagagccaaagtatcctgtgaaaacaaagctttatatccaaaaatgtgcttttgcaaaattctttaatctgtgtaatggagggcagagggtatggggtaggagggtgggagaaagaaaagaaaagaatttggattctaatttatgaccatcttgacatatggtcaaaggtgtcattttcctactcagtttcaattctgagttaatttcttaagccttaaataataagaacaatggacagcctggcctggcagagagtttcacagatgacttaatctgagcaccatcacagagaagtcaggactaaaccccctactgagcagggcggcggagtgtccaaaggtctcagttctgtggagcagagtaccacgctttctgtggaatggggacagggtcaccacgctcactaaaatgcagtatgttccattgcagcaaagctttcgcctgtgttcaaaatgcatgtctagcagattgcagccttttaaattaaatatatataaatggttgtatatagaatatactctggactgtgagggcatcctattttggtatgcctcctggctgtggatggcatgtccagtgctctgtgagtgttttcagtcattcacattcactatgtgtttagagattctctccctgcttacagctgaaggatgttgatacaggcatcaagaaggctgaggggcagatggggcctgcaggttaaggcattgttaacttgctccatggaaatgtccatatcttaatgagtaaaaaagtgtatttttctgatacgtaaaccagaattgtgggcgtgtaggtcacatcactatttctttagcagcaaatctgttttcccagttgagagagacaatagcttctgcacaagaatatatgatggtaggatccatctgttcaattgtgtctgaaagaatctttattccaaagcgaaacctggggaaatgttttaccttcagccagatgctgtgtgtgtacttgggtcccttgtctttcctctaaggagaggtgcttgtggaaagtggaggttgtgggcatcttttcaaccttttcaatctgacctttcaacaggtcaggtgagagaaaagacaaagctatttgaacctatgtttttcttatgtccagaaatccgttctttcatcaaaccactaaaccactcgccttagcctcttctgcagtttctggtggctctatctgtgggcaagggactcctgcctgtgagaagtggccaggccctccagagcaacggggtctggcttcagggagcagtggggtgtggggaaagcaatgttcatcttggctgctccatttttataccatccatcaaggactcttgcgcttctctccacctgtgacgtagcagcattgccttctttcctcttggtgcttctgggcaaaactggaatttgaaatccagaactggcgttgtcttcttaaagagtatggttcctgcctcagttccagcctggtatggttctttgatatgccctgaaggttctcacatggaaacatcagtatcctgccattcatgttgttttaagatgttttaaaaaccaatggacaaacttcttgcttcaaggaacaaactcttaggttggcaacagcatataaaaaaaaagatcacagctgaatctcatgaaagattaaaaaccaaaggattcaagaccggtgttgtaaaatgaagaggaattttacttacatgttacagctgccaagtttttagatgttcctgtcatagctaaatagtcactgctagcctttcagagaacagatagtaacaattgtttgcagctgcagtgttgcatctaattttggtgtttaggctttttattttgtgggaagctttttgttaatatcctgcagggcaactgcctgttgggagggagaggatggaagaaggagcttactctgggggccttgcctattgagggaggctgttgcccagagcagttgcttcatggaagtcatccaaaggcgctctcagtcattacaatgacaggatctcaaagttgggaaagggctgttaagtcatccagtctagtctccacataggtgctgacattctgcctacaaccatcccaccaaggggttgagcagtctggacttaaacacctccgaggacagagaacccactacctcgtggagaagcctgttctttgtaaacctctggcttttctatgttctctgtaatttccatcttagtctctgccccatgggggccacatgggacaagttatttttggcaaagcacctaattgctggcactgtcccaaagcatagcgtttgccttttggaaagaaacaatgctaggacatggacactttggtacactgtccttacccctgagtattagtccactcagttccttgttggagaatgttgagaaaaccctactggctggcttgtttctgccaaagcttggggagaggagagggggatgagaagatgttagcagcctgctaaacctcagacagatgaggactcagttctgtgcttgccccacaaaaacggatgctcacatcatcaggaaattgttcagctggaggatttataacttcgttgctttgcatgaagtttaaagttttcatggttgcccagggcttgtaccttagattcctgtaaggactttgcactgtttttgctgagaaaacaacgcttcaggacttaaggtctaagcgtcagagaagtgccgtattttcaaggtggaaagtctgttaagcttgctgttgtccaatcatccgtttttagagatggggaaactaaaactcaaaaagatgtgcctgaggtcatatggcattatcagaaccaacctctggccctcttgacctgtctagcattctttctttctgacctataggatgactctaattcagtctaaatcggctgccctcagattcttgagaacttaaaattgagcagaaattcccaaggccaacctagctctcagggaccaacctgcagaactcaagattgagcgaaatgtttaggccagttgagttttgcaaaatgagtggtaagggaaaacagatctagcctgttatttaaaaccagggttcaaaagccctattgggagaggtagtattgtcctagcatttaaattctcatgaaatgtgcttggtctgtgatctcttggtcagatatctgccttccaggcgatcctttgaggttgtgtaattcagctggccctggctcctggtccctgttactgagctgggcagtcgaaccgaagggcagatgagctcaagatcatgccttgggaagcatggtgctctaggggtgcctttttattcctttcattgtattatagactgtttccaagtttatggttagaaatggtaaagtgggtctggtgttttgaggtagaacccagcctagggcaagatatgaactgttcttgaggtagaaatgtctacagtcagttgtttcatctagcttgcatcttaaaacacaaacccttcagttgctttcacttaatgcacacatttgccaatgacagagggttatacaggatccttcttttacatttctattgtctgctacgctcatcagagtatattttggggtacaaggttttgggggttttttttcccattttgtaactgccttattgaaaagtaagtgcccttccattccaggcctcctcatattgtacttgtttcctgccaaatctgggggatcatttgtattttaactttgtaatctatggctctgtactgttgaaaggctctcaattctgtggggtctccttagtatgtatgtgacttttcatgttgcaatatcacacgatgggatggcccgacttttgctcttaataaataatctgaatgagtaagagaaaaaaaaaaaaaaaaaaaaaaaaacaaaacaaaagaaaaaacacaaatcaaaaaaaagggggggggcgccgccctcaaaatatattcctcccccggagggagcaccaaaagattcataaggtgattaccccacagtttctcatgtgatccacaaaaggtgtggcccccaaaaatagtgagggctccttatatataagagacatacgagaagccacgggcgcggtcctgttataacacacgtcatcgggtacggggaaaaagaggtgtgcttaccatgggggaactctttggtgaagaagacacccacaactaacggggggagggagacaaaaaaattggaggaaaaatcaccccccacgcaaatcttgcacagacccaacagcagtcaaattaacaaaaacctcgcggtgtgtagaagggtggaacaaccaccgacgatatgcgtgccgcctcgaaaaaattgcgcaccaggcattatccattcagacatttcccgaggcctgaaccac

SEQ ID NO: 451406 - DNA, 3227 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcaactgtgtccagcaaaggagtgcctggagggcagagtctgtcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaa

SEQ ID NO: 451407 - DNA, 406 bp, Homo sapiens
ctcaccactacagaccagcccacactaagggtgaccagatatcttagactcccttttgaaacaacaggaaccaaagtgccccagggcagagaacatcctgttgccaaaatagtggttctcaacccagggatgacttttgtccttcccaggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccggccaaaagaaatggaatcaaaaaagaaaattgtttgcaacttcatagagataccctcaatgaataaaaccacatatggtttga

SEQ ID NO: 451408 - DNA, 409 bp, Homo sapiens
gcacgaggcagtggggggaggaaaagggggaggaagagggggacgaggcccttcctgcaagctgtctcaggtcgtaaactcagtgacctgaggcaccaggggtctgtctttgcagctgcacccctgggtggctccggtaccagcgccctactcctttaattagacaccagcgcctgcctatgatgatggtcgggggcgtgtcagggcctcgggggccgggaaaatagagacccctcgagtatctatttctacatagtcagctacttctgaaactgcagcagtggcttagaaagtccaattccaaagccagaccagaagattctatccccctgcctcggcttaccacaagtactgagattacaggcgctgagcctggtatgtgcctgggccagggcacagtaagtgggta

SEQ ID NO: 451409 - DNA, 4454 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451410 - DNA, 4310 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctggattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451411 - DNA, 4078 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451412 - DNA, 1686 bp, Homo sapiens
gtggcctgggggcactgggcccctgggtcctccagaccactgacatctctttaaatgactcagctcggccctggttctcgtctcaccagtggcattgtctgtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451413 - DNA, 4400 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451414 - DNA, 3216 bp, Homo sapiens
  misc_feature (2236)..(2236): n is a, c, g, or t
  misc_feature (2262)..(2262): n is a, c, g, or t
  misc_feature (2268)..(2268): n is a, c, g, or t
  misc_feature (2289)..(2289): n is a, c, g, or t
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggntcagcactttggacatggctcacaancagttnttgattgactgcatgaatgcntgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattgatgaaaatgaaaatgacagatctgaggaagagggagagcatgctatggacatgatgacgcagtagagcccgcagattcgagggatgatggtactctctgtgtattcc

SEQ ID NO: 451415 - DNA, 1055 bp, Homo sapiens
gcacgaggcagtggggggaggaaaagggggaggaagagggggacgaggcccttcctgcaagctgtctcaggtcgtaaactcagtgacctgaggcaccaggggtctgtctttgcagctgcacccctgggtggctccggtaccagcgccctactcctttaattagacaccagcgcctgcctatgatgatggtcgggggcgtgtcagggcctcgggggccgggaaaatagagacccctcgagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451416 - DNA, 3332 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccggccaaaagaaatggaatcaaaaaagaaaattgtttgcaacttcatagagataccctcaatgaataaaaccacatatggtttga

SEQ ID NO: 451417 - DNA, 1355 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctggattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaagtaagttcccacttaccttt

SEQ ID NO: 451418 - DNA, 350 bp, Homo sapiens
aggaacttaccatctaaaatatctgctatgacacagatattcacgcacaaggaaggctgtagcacctgcaaagaggctacataaaatcaagaaatcatttctaatataaacagtaattgcatttcttctggtaggtgaaatggctccagcaacaggaagtgaaacgaagggtgaagagacaggtgcgaagtgacccgcaggccctttacttcaacgaccccatttggtccaacatgtggtacctggtgagtaggacaggacctctgtctgccccaggacacttgcactgccaggtctctgaaatgggttaatttccctcaacaaagctaaattcaaacaacatctccaga

SEQ ID NO: 451419 - DNA, 426 bp, Homo sapiens
ttcttctggtaggtgaaatggctccagcaacaggaagtgaaacgaagggtgaagagacaggtgcgaagtgacccgcaggccctttacttcaacgaccccatttggtccaacatgtggtacctggtgagtaggacaggacctctgtctgccccaggacacttgcactgccaggtctctgaaatgggttaatttccctcaacaaagctaaattcaaacaacatctccagacagacacacttcaccttgagggtgtaaaaccactaccgcaaggctgtgcagtaccggctttcctgtggattttttctgaaactttgtgcagcacactctgggatgggggctctttgagaagggaagtgatttgatgcaggctgtatgactaaatggcaaagcccagcccatggacagagctcctgctgggaggcgatg

SEQ ID NO: 451420 - DNA, 513 bp, Homo sapiens
agaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattgatgaaaatgaaaatgacagatctgaggaagagggagagctctcttgaaacccctttcccagatttgccctcagttttaggaatgaggtacgcttgggcattcctgttgcctgcatggttcggcattctggcagccaggttcgccccagaatagataagtgtgtttgattttcgaacatttgactttattacctatttccagaaacacttcgtgttcaaactacgtctctacaggcatttctacttggtctttttctcccctgacatttcacagagtcctaactgtgctgcatgtataacttgttctttctttttgttacttgcatagcaagcatgtttctatgtcattaaatatcctttgtaagcagca

SEQ ID NO: 451421 - DNA, 3188 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcaactgtgtccagcaaaggagtgcctggagggcagagtctgtcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaa

SEQ ID NO: 451422 - DNA, 2073 bp, Homo sapiens
gtcgactgctaccttttttttttcaaactccaattgttcactgctggcatataatcgatttttatatattaactttgtaccctgcaaccttgctaaactcactgattggtccgaggagttttttttataatttctttacacttttctacatgaaagaatctatctcctatgaatagaggaagtttaatttctctcttcccgatatatatgcattttattcatttatttttgcctaactgtactggctaggacttttactaccatggtaaatatgactggtgagaaaaaaaaatatcattacctagctccaaatgctagaagactgaatgctttccccttatgaagtattttagctgtatattttttgtagatgctctttattaagttcctttctattactagttcattgagatttttttttttaaatgatgaatagatattccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagaggttcgtttccacactctcgattctgttccattggtctgtatatctatcttggagtcagtaccatattgttttgatcactgtagctttgtagtaagttttgaaataagaaagtgcgagtcttcca

SEQ ID NO: 451423 - DNA, 4415 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451424 - DNA, 4400 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451425 - DNA, 3948 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451426 - DNA, 4400 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgctttttgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaaaaaaaaataatttataaatttaattatatatataaaattt

SEQ ID NO: 451427 - DNA, 3238 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccggccaaaagaaatggaatcaaaaaagaaaattgtttgcaacttcatagagataccctcaatgaataaaaccacatatggtttga

SEQ ID NO: 451428 - DNA, 2503 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccggccaaaagaaatggaatcaaaaaagaaaattgtttgcaacttcatagagataccctcaatgaataaaaccacatatggtttga

SEQ ID NO: 451429 - DNA, 995 bp, Homo sapiens
  misc_feature (882)..(882): n is a, c, g, or t
  misc_feature (891)..(891): n is a, c, g, or t
aaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatatgcttcctgtaattggttttcccgtccttgatangtaggaggnaaggggcagagttagggatgccgggttagatggatggggattactgggtgggtctagggatggtggttaggaccgtttgaattacagtttgtggtggggtaaag

SEQ ID NO: 451430 - DNA, 729 bp, Homo sapiens
ccgtgttctcgcgcggtaaattttctattttccgtgggcgatttttgaccgcagcatttgcgctggtttcccccgattcgcctgtattttgatttttcctggggtcgttaatctttggtgtgtgatttgtcccccatgtgttgcgcccccccccgcggttatgggtcctctctcccacaggtgttcccccgtggacgcggttttccccgcctccccgacgggttgggttatactcccccccctttgccttctcgttattgatatacacgcctccccatattggggcccccctttgtcccagaaaactgggtgcacggctcatgcctttggccccccccggggattttttccccccccccccctttttttttttttttttttttttttttttttttttttttttttttttttttttgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaagtgtcctggaaaacatattttaaaaattttaacacttttctccccttgtagaaaactttaaatttaaagtctagacctatacagaccaattcag

SEQ ID NO: 451431 - DNA, 880 bp, Homo sapiens
aaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaa

SEQ ID NO: 451432 - DNA, 1130 bp, Homo sapiens
aaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaattaattacaaaaaaaaaaaaaaatataaatagaataaaaaaaaaaaagaagggggggggcgcgggatataaaaaattatccgcgggggggggccaatattatgagcgattacccaggtttttttgtagcaagggggggccccaatagagaggagaataaaaaaaaagaagagaagaggcaggtttattaacaaggttttggtgatgtgaaaaaggataatcgtggaaactttgggaaggaaccacaacttgggggtgaacatttgggcacaatctcctaagagaataagagctcggatatgtaacttgaggtgttgtgttaacaaggattatcgagaaatggtaagatattgaattagg

SEQ ID NO: 451433 - DNA, 2113 bp, Homo sapiens
aaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctccaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatgcaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctc

SEQ ID NO: 451434 - DNA, 1980 bp, Homo sapiens
aaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggagaatggtgtgaacccgggaggcagagcttgcagtgagccgagatctcgccactgcactccagcctgggcaacagagcaagactctgtctccaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatgcaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctc

SEQ ID NO: 451435 - DNA, 562 bp, Homo sapiens
aaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaa

SEQ ID NO: 451436 - DNA, 7727 bp, Homo sapiens
cgggagcggcgggagcggtggcggcggcagaggcggcggctccagcttcggctccggctcgggctcgggctccggctccggctccggctccggctccagctcgggtggcggtggcgggagcgggaccaggtggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451437 - DNA, 352 bp, Homo sapiens
gcggccgcctactactactaaattcgcggccgcgtcgccacagcccaggtcacagtgaaaggtgagtgtggcaggtgctgtaaccagtgccctccctgtcatctgggaggtcctggtggtgggcgaatgtgagctggctgccatgggcacaggcatggctgagggattcttgccctttcctgggtgtccctgccctggggtcctccagcccttagagggagggagggatttctgttattagccggcttaatgataatagttaaggcatattgagttgcttgctagcatgatgtctcccacgtcgagcggccgcgaatttagtagtagtagtagtagtagtagtcgcggccgc

SEQ ID NO: 451438 - DNA, 564 bp, Homo sapiens
tgaaccgggagttgttctggggtgctacccccatgggtactttgaggcccaaaagccctccctctgtcctccctgggcaaggtcccttccaggccaggccctctccaggtcagagtccttcaccatcctgtctccctttctctccctctcccgcggtcagtggcggccagaggagtccgaggactatgtaagtaacaggtgtgcgaacgcggacaagacatgggtcaagctgggctcgtgggacgctcctcctctccctcctttcctgctagcctgcactgccaagatccacagggctctagccacatcaggagaaaattggcgtttagacacaagcactgagctgagcagcgattggcatttcctctaatccttacttcttgcctgtcgagcagcaatttgaggccagtgttcatgatcgaccagggcctggcccctgccccggccagacagggatggagttaaatccaatcctgatcgttaggccttattgatccctggagtgaaaaatcacctgctttagggcccaggctgggagggctgtctggagagtcggattctggc

SEQ ID NO: 451439 - DNA, 438 bp, Homo sapiens
cccgataagcccgacagccctgagaagtacgacaggcgggacaagcagcaggcccatgcgcaggctggggtgaggggggtgtgccaggtgggcgctctggtgactggctgccccttcagcattagcccaccagggagcttcgtcgggagaggtccatggagctggagctgagagtgcggctgtcagagagacctgtgcctgtcgggctagtcggggccccgactagcccgacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcgggctagtcgggggggtaccgagctcg

SEQ ID NO: 451440 - DNA, 7600 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451441 - DNA, 7704 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcaggtgagtgaggggtcaggacggacctgagggtggggcagcaggagggcagcgccagagcccagcccgtggtccttcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451442 - DNA, 9327 bp, Homo sapiens
  misc_feature (817)..(817): n is a, c, g, or t
  misc_feature (2594)..(2594): n is a, c, g, or t
cgtatataaacttggtcatgtggcttggttttaaaacagttcccttgactgtaattggcaggtgatagcatctacagcatggaaacctgcacctagtaggtgcttaagcatagcttcccttcccatgaagaggaggagacagggcacccactggccgagaggacaggagagatttagttcattaaggctgctcctctgtgctgcccccaccccgcttctgtggcaggcctggacctgatctgcaaacagacttgcctgcctgtgcctgtccctgaggcccatctccagagcagagggagggcatgcaccgctgggctgggtggtggtcctggctgagcctcctgctctcaccttggaccatttgaggtgcgtgctcagagagtcctttgttgccatgagacacttgccagccatgtcccgggatccacctgttctgccacaagaactgtgtctgtgacatgctgtcatcattggtagagactcctggcactagaacagatgacagaaacccacttataccagcgtaagcaaaacaaggaagtcctgtgttacaaatctgaaaagtgtagtagatttggtgctgggcagggctagatccaggtacttaaacaggttggccaggcatttgtctgtctgtttctgagctctcctctcctatgtcgacatctttgttctcaagcagcttttcctgtgtgttgggagaagccatccccagctgctctaagcttagctacctcagtagagagagaaggtcgcttttctaatagtttctgcggaagtccaaaggctgtttctccatagtcagatctgggtcacncaccccatgtatgaagaatgcaggtagaagtggtttccttaaagacaatgggaatgctcattgatttgaggagaaagcagaaccctgaatgtctacaagatactctcatgccctaggtgaacctggggacacagatccagcccaccagcacctgtcaggcctggtctctggggctgccagggtttgggttctgtctggagcaccagagtaaggcaggctgtggaaggagttgaagcaagtgctaaattaggtagggtctcttgggctgggcagaggagtcactgggagccatgcaggagcttgttaaacagggagtggcatcagatttgtgccagctgtttgtggagggcccgtgagcaggaattggggcagtggacaacaaggcaggaggactgacgcagaacacattgcagcaactcagggaaggatgatgatggcttggactttggtggtggcagttgcctgtgtgtatggagagaaatacatggatttggaagatatgttatgccacgctgttgacaggacctggtgacttgctgaatgtctgatctctgggtctaagttttgacccctgtatggtgaggtcagacgttggaccgggaggtctctgaagttgcttctagctctagttctgtgatttggggctgtgtgagcagcatagtctggtgcttatagtggagatgctccttatgtggtgctgtggggtctttgcatgcctgggccccccagcgagggtcctcagagaccagtgctctcagcagtgctcttgggtactgactagcctgctgcctgccgcctttggccctgcgtgtgagagtgcccgtgtaggacacaccctggcctctgctcaccagctgcatggcccatctgcatgccagacatgcctgcccacggctgggtttcatcacctcccttccctctgcatgctcctgtgtctgtgtcaagcttccaacttcgggggcgggtggttctaggctgtaccctggactgagaagctcagaacagcttctggtcaggggagtccaaggctggaggtcgtggccaggcacagccacagccacccctccccttgagacccttgtttgttggcgcaggaagccgtctgttcggcgccctcatcatgttactgccatcgtcatgcccatcctgcccgcagaccatgtccctggcctgccctgacccctgcccctccccagtcctcctgagggcagcccttttgcttgggttcccaggttgtgccctgagcatggctgagaccctggcaggcggccctgctgcttgccttatttcttcccctcaggccatggcctggaggtggaggcagtgactccacggcaggtggctgtgtccctctggactggccttctgctctgcccagccatgctctgaggaccctccaccctagggcctgctttctctccttggtgctccagccaggagcaggcagagataggccctggagaacaccctgggttgtggtcctgaccaggcctggaccttgtactgagtccctgtgtgaccctgggcagacaggaccttcctgacaggcctcagtttcctaggctataaaatgggagcttggttgcaagatctctcattgagtaagtcatcgtgctccagacagtccctgagtgtgggggccacttctaggctggaagtgggtggggtgggagtggatgatgagctggggtctggcggtgccacccctcctgtctctgagcatgggtttggctctgaccagaggggcttcctgaatgaggggcccctgcccttccangcagtcgtgtgtcctgcccggcctgtgagtgcctctctccctcctcctgcagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451443 - DNA, 5581 bp, Homo sapiens
cgggagcggcgggagcggtggcggcggcagaggcggcggctccagcttcggctccggctcgggctcgggctccggctccggctccggctccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451444 - DNA, 3970 bp, Homo sapiens
  misc_feature (33)..(33): n is a, c, g, or t
  misc_feature (35)..(35): n is a, c, g, or t
  misc_feature (43)..(43): n is a, c, g, or t
cggctgatcttgatggatccctataggcgctangntggagcanccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451445 - DNA, 3580 bp, Homo sapiens
cctccgccatccctgtcgctacatgtgctgctgtctccatgccaccagttccaagtgctccatggtcacacatgttcacatgtgcacatacatgcgttggggctttctctgccacactgctcaagcctcacactaatgctgcctgtgtatgccctacctcccctaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451446 - DNA, 7574 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcatcatttaggtaagggatcctcagg

SEQ ID NO: 451447 - DNA, 7628 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgtaagaaatctgattattcaaatttattaccatcaagaattatgcaatgatgctgtagtttttcttaacaaatagaagacagactgtgtacaacagtgaactctacagcactagcatccacaaggtagaaatgaatgtttcatcatccaacattaccaaccctggtcgacgcggccggaatt

SEQ ID NO: 451448 - DNA, 7508 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctcagaaccgacaaaccaaaaacaaataaacaacaacacatacacaaaaaacacgaaacacaaacaaaacaaacaacaacgacaaaaaaaaacaaacacacaaaacaaacgaattatatcctccccagacagcacacagaaaaaacaccaaaaaacaacatgtggatgctagtgctgtagagttcactgttgtac

SEQ ID NO: 451449 - DNA, 7238 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccaacaaagcaaccctggtacagagctcgatcactgccat

SEQ ID NO: 451450 - DNA, 6328 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451451 - DNA, 6403 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttcaagaatttaagaattaaaaaacggattggttta

SEQ ID NO: 451452 - DNA, 965 bp, Homo sapiens
atcaccatcgtgtttgcaaaggtgatgaggaatgccttgccaggctctcccagacacatctgtggttctgggctgtgaatgttaaacacacactgggatagacgaccagcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451453 - DNA, 821 bp, Homo sapiens
cgaaacccttgcggtactatatctattgcgccagttttcaatttctatcgcctatactttatttgggtagggtttgatgacgtcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451454 - DNA, 682 bp, Homo sapiens
gcggccgcctactactactaaattcgcggccgcgtcccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451455 - DNA, 5610 bp, Homo sapiens
  misc_feature (18)..(18): n is a, c, g, or t
  misc_feature (5452)..(5453): n is a, c, g, or t
  misc_feature (5456)..(5456): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcaggnnaangccccgtactggcagggagcggtcggtcgtacgtacttgtcgttgccgtggtggtcacttggccgtatccggtggttcgccgatccggtggcggaggaaacgggtccgtcacatggccgcggggtgccacgggggccggtcggcgggaccaggg

SEQ ID NO: 451456 - DNA, 4246 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccagtacgcgagaccacccactaatccccctatccgctatccaatgggtaaccttagagtcacc

SEQ ID NO: 451457 - DNA, 3741 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaaggtgtgtgctgtggacatggcatcccttcccgagtgtggctgcatctgggggtctctgctctccttgagccactgacctctggcgactgtgatccaccagcctctggtgtgtgacctccaatctctcatgactgtgaccactaacctctagtgaatgggcaccacattcttgatgcctgacctctgctgtccttaacctactgacctctgctgtatgaccttctgatctcttgtgaccttgacccactgatctcttttgactgtgtcactattcttgggtgtgcaacctcctgatctttggtgtgtgacactaatctcttggggccatgacccaccgacctctagtgaacatgctccaccacgctctggtgtgtggccacatgcttctcatgaccgaaacccactgaccctctgatcactctggcctggtgtcatctgaccccatcattgggatacctcatagga

SEQ ID NO: 451458 - DNA, 2957 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgtaagtaacaggtgtgcgaacgcggacaagacatgggtcaagctgggctcgtgggacgctcctcctctccctcctttcctgctagcctgcactgccaagatccacagggctctagccacatcaggagaaaattggcgtttagacacaagcactgagctgagcagcgattggcatttcctctaatccttacttcttgcctgtcgagcagcaatttgaggccagtgttcatgatcgaccagggcctggcccctgccccggccagacagggatggagttaaatccaatcctgatcgttaggccttattgatccctggagtgaaaaatcacctgctttagggcccaggctgggagggctgtctggagagtcggattctggc

SEQ ID NO: 451459 - DNA, 1952 bp, Homo sapiens
  misc_feature (18)..(18): n is a, c, g, or t
  misc_feature (1927)..(1927): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaagtaaaatcgaccnccctgcagggttttccatgtctcgg

SEQ ID NO: 451460 - DNA, 543 bp, Homo sapiens
cccaagccgcgcatcacatggatgaagaaggggaagaaagtcagctcccagcgcttcgaggtgcgtctgtggtgggaaggggtcggcagggctcagggtctgcccacactctctcctttcagtgtccctcctcatggaccttttggaggtgggaggacaactgaccctgagcaggctcctgtgtcctgagtaggctgtgaccccatgtctgtcctctgacaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaaggtacgtgctagggagacgtggcacggtgggctgccgggctgaggcgtgggaagagccagccagccctgatcctgtcctgggcccatgtgcatttggcagaaaggaggactggccaccttggggtcagtgaaagtcagtggtggacagggatagtcattggatctggcctggattgtgcg

SEQ ID NO: 451461 - DNA, 770 bp, Homo sapiens
gctcacgccacactcctgctctccctaccccctccctgccctgtgttctctcatgtcaaggctgttctggccctggctcctccgcgctcagagatcctgggaagaggtggggcagtaggaggacagagccgtggacatgggggctccttggcagccagccatgccatgtgtcactgtctcagcctggacctcaggttctcaccagcctcccttctgtctctctaggaaaaggacccactctccgtcctctaaggatgagcagtcgatcggactgaaggactccttgctggcccactcctctgaccctgtggagatgcggaggctcaactaccagaccccaggtagggcactcctatggcctgtgtgcccccagcccagacctagcaggcctgtgggtctgttctgcaggtctcagggtcgccactgaagttcctgggccgcatgcacttgttcctgctccttttcttcctttctgcccttctccctgtgctcatccactttggttggaatgactggggagcccccatatcctgcagctggacaggtgccccaggccaggaccctcttaggtggcaaagccacttagccactgccttgtcttcagtcaaggcctctgaatatgggctgaggacctcccagagcccacgtctctgccacagggtggccagtgtctggcgcacgctctgacgcctccacatgaaagaggggcatgttaagcagtgggagatgcctcaccagacatctgtggggagatgaagtgcctgcacctg

SEQ ID NO: 451462 - DNA, 473 bp, Homo sapiens
atgatctaaggaaactgtatcagggcctttcctgggggagtggggtgctgaggcaggaccctcaagtttgctgtgcccacctgagctagggttgatacctccaggcctgacttccttctctacctgaccccccagtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggtgcagcattgggtggtggtggggtggcagggtgagcacagaccagcatgcacaagctcccttttggggcccagatatgtccctcttcccctgcctgccctcagcagtgctgtgactgcctttccttggttgtgagacccgaga

SEQ ID NO: 451463 - DNA, 3778 bp, Homo sapiens
  misc_feature (817)..(817): n is a, c, g, or t
  misc_feature (2594)..(2594): n is a, c, g, or t
cgtatataaacttggtcatgtggcttggttttaaaacagttcccttgactgtaattggcaggtgatagcatctacagcatggaaacctgcacctagtaggtgcttaagcatagcttcccttcccatgaagaggaggagacagggcacccactggccgagaggacaggagagatttagttcattaaggctgctcctctgtgctgcccccaccccgcttctgtggcaggcctggacctgatctgcaaacagacttgcctgcctgtgcctgtccctgaggcccatctccagagcagagggagggcatgcaccgctgggctgggtggtggtcctggctgagcctcctgctctcaccttggaccatttgaggtgcgtgctcagagagtcctttgttgccatgagacacttgccagccatgtcccgggatccacctgttctgccacaagaactgtgtctgtgacatgctgtcatcattggtagagactcctggcactagaacagatgacagaaacccacttataccagcgtaagcaaaacaaggaagtcctgtgttacaaatctgaaaagtgtagtagatttggtgctgggcagggctagatccaggtacttaaacaggttggccaggcatttgtctgtctgtttctgagctctcctctcctatgtcgacatctttgttctcaagcagcttttcctgtgtgttgggagaagccatccccagctgctctaagcttagctacctcagtagagagagaaggtcgcttttctaatagtttctgcggaagtccaaaggctgtttctccatagtcagatctgggtcacncaccccatgtatgaagaatgcaggtagaagtggtttccttaaagacaatgggaatgctcattgatttgaggagaaagcagaaccctgaatgtctacaagatactctcatgccctaggtgaacctggggacacagatccagcccaccagcacctgtcaggcctggtctctggggctgccagggtttgggttctgtctggagcaccagagtaaggcaggctgtggaaggagttgaagcaagtgctaaattaggtagggtctcttgggctgggcagaggagtcactgggagccatgcaggagcttgttaaacagggagtggcatcagatttgtgccagctgtttgtggagggcccgtgagcaggaattggggcagtggacaacaaggcaggaggactgacgcagaacacattgcagcaactcagggaaggatgatgatggcttggactttggtggtggcagttgcctgtgtgtatggagagaaatacatggatttggaagatatgttatgccacgctgttgacaggacctggtgacttgctgaatgtctgatctctgggtctaagttttgacccctgtatggtgaggtcagacgttggaccgggaggtctctgaagttgcttctagctctagttctgtgatttggggctgtgtgagcagcatagtctggtgcttatagtggagatgctccttatgtggtgctgtggggtctttgcatgcctgggccccccagcgagggtcctcagagaccagtgctctcagcagtgctcttgggtactgactagcctgctgcctgccgcctttggccctgcgtgtgagagtgcccgtgtaggacacaccctggcctctgctcaccagctgcatggcccatctgcatgccagacatgcctgcccacggctgggtttcatcacctcccttccctctgcatgctcctgtgtctgtgtcaagcttccaacttcgggggcgggtggttctaggctgtaccctggactgagaagctcagaacagcttctggtcaggggagtccaaggctggaggtcgtggccaggcacagccacagccacccctccccttgagacccttgtttgttggcgcaggaagccgtctgttcggcgccctcatcatgttactgccatcgtcatgcccatcctgcccgcagaccatgtccctggcctgccctgacccctgcccctccccagtcctcctgagggcagcccttttgcttgggttcccaggttgtgccctgagcatggctgagaccctggcaggcggccctgctgcttgccttatttcttcccctcaggccatggcctggaggtggaggcagtgactccacggcaggtggctgtgtccctctggactggccttctgctctgcccagccatgctctgaggaccctccaccctagggcctgctttctctccttggtgctccagccaggagcaggcagagataggccctggagaacaccctgggttgtggtcctgaccaggcctggaccttgtactgagtccctgtgtgaccctgggcagacaggaccttcctgacaggcctcagtttcctaggctataaaatgggagcttggttgcaagatctctcattgagtaagtcatcgtgctccagacagtccctgagtgtgggggccacttctaggctggaagtgggtggggtgggagtggatgatgagctggggtctggcggtgccacccctcctgtctctgagcatgggtttggctctgaccagaggggcttcctgaatgaggggcccctgcccttccangcagtcgtgtgtcctgcccggcctgtgagtgcctctctccctcctcctgcagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaaggtgagtgtggcaggtgctgtaaccagtgccctccctgtcatctgggaggtcctggtggtgggcgaatgtgagctggctgccatgggcacaggcatggctgagggattcttgccctttcctgggtgtccctgccctggggtcctccagcccttagagggagggagggatttctgttattagccggcttaatgataatagttaaggcatattgagttgcttggtgggagacatcatgctagcaagcacagttgattttgtttttttctgttttaccctgggagataggtgctcttattatttccatttttgaaacgagggaaccaaggcacagagagggtgtatcacttgccccagggtcacataaaaataaatgacagagcagggacttaaacccagtgtggtctgaatccatatctcaccctcaccactacatagtaccagaccttcaggtttaatagcctcccagcaagaagggtgtggtaaaatagtaggggaaagtgtgttctctctgccctgatacctggggacaggcacacatgtattacacatatgtcacatatatgtaaccgattctggccaggcacggtggctcattcctgtaagcctagcgctttgggaggccaagttggaaggattgcttgagctcaggagtttgagaccagcccagttaacgtagtgagacccccatctctacgaaaaaaaaaaaaaaaactgggcatggtggcacacacctgtggcccagctacttgggagggctgagacaggaggatcacttgagcccaggagggtgaggctacagtgacgcagtgagccatgatcacaccactgcactccagcctgagtgacagagcgagaccctatg

SEQ ID NO: 451464 - DNA, 357 bp, Homo sapiens
cctccgccatccctgtcgctacatgtgctgctgtctccatgccaccagttccaagtgctccatggtcacacatgttcacatgtgcacatacatgcgttggggctttctctgccacactgctcaagcctcacactaatgctgcctgtgtatgccctacctcccctaggtatgcgagaccacccacccatccccatcaccgacctggcggacaacatcgagcgcctcaaagccaacgatggcctcaagttctcccaggagtatgaggtgagatgttcccgccccctaccatgtgcctggcccaggcctacccaaaccagctcctgtcctgtcctaggtcccagctgtggtgggtgagga

SEQ ID NO: 451465 - DNA, 246 bp, Homo sapiens
catgttaagcagtgggagatgcctcaccagacatctgtggggagatgaagtgcctgcacctgagccttcctggaggccgaccccaggtttaccataccacgtacctgccccttctcctagccactctcatggggctgtccacctcttccttctacctgaaatgttactcctcccaacacccagcagacacagctcagacctctcctcttgcccacacccccacagggttaggtgtctcttcttggc

SEQ ID NO: 451466 - DNA, 7680 bp, Homo sapiens
gcgtgtgtggactgaaacccaaaagccagaaactctctgcatgtgtccctcatggagccatatggtctctagtctctgtttttcaaaatttgcaggactgatgactgattggacagtggtgcaggagggaaggtctctgcatgtcagtgattaaattgctgaagatgccactgcctgagacgggcagtattgaaggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451467 - DNA, 6926 bp, Homo sapiens
aattcaggggcacgagtggcagaaccccctggaagaaattttccttgcggtttcaaaggggaagggtgttccctttcccctggtaggtaaccccatgcacacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451468 - DNA, 5302 bp, Homo sapiens
gcatcctacctgcctgcttcctctccagcagaggccaccattgtatagccccaccttccacaacccctggccttgtgtgccccggggctcccctcaggctagggtcctgaggtccctgacaaggtctggcctctccctgcattcttgtgatgggaacgaacccctcctcctccctcaggaaaccactatcagcggcctgaccccggagaccacctactccgttactgttgctgcctataccaccaagggggatggtgcccgcagcaagcccaaaattgtcactacaacaggtgcaggtgagtgaggggtcaggacggacctgagggtggggcagcaggagggcagcgccagagcccagcccgtggtccttcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451469 - DNA, 7818 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaaaaaaaaaaaaaaaaaaaaaattgttgcgcggcggccctgggaccccaaaaaaagtttttaaaaccattcggtggggcgcggcgccccgtggttgtcggacacggggccaacctggcccagagggccccgggccggcaggctgtggtccccccaaaaaaaggcgggggccggggtggcacaccaggggctcgggccccggcttcagggccagcgacccg

SEQ ID NO: 451470 - DNA, 7596 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcatctctggtggtaaatatgatatcaagtcccgtctcgtcctggcccc

SEQ ID NO: 451471 - DNA, 7385 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctcggcagctttgaccactatgcaacgtaactaccgctcccctctcctccgccacccccgccgtggggctccggaggggacccagctcctctgagccataccgaccatcgtccagccctcctacgcagatgctgtcactggcagagcacagcccacggggatcacagcgtttcaggaacgttgccacaccaatcagagagcctagaacatccctgggcaagtggatggcccagcaggcaggcactgtggcccttctgtccaccagacccacctggagcccgcttcaagctctctgttgcgctcccgcatttctcatgcttcttctcatggggtggggttggggcaaagcctcctttttaatacattaagtggggtagactgagggattttagcctcttccctctgatttttcctttcgcgaatccgtatctgcagaatgggccactgtaggggttggggtttattttgttttgtttttttttttcttgagttcactttggatccttattttgtatgacttctgctgaaggacagaacattgccttcctcgtgcagagctggggctgccagcctgagcggaggctcggccgtgggccgggaggcagtgctgatccggctgctcctccagcccttcagacgagatcctgtttcagctaaatgcagggaaactcaatgtttttttaagttttgttttccctttaaagcctttttttaggccacattgacagtggtgggcggggagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggactgcttcagtttcgtcgacgcggccgcgaat

SEQ ID NO: 451472 - DNA, 6555 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgcccgcaacctgtatgcccacatccagaagctgggccaagtgcctccaggggagagtgtgaccgccatggagctcgagttcaagttgctggccagctccaaggcccacacgtcccgcttcatcagcgccaacctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggtcgacatgtttcagaccgtgaagaccctgcgtacacagcgtcctgccatggtgcagacagaggaccagtatcagctgtgctaccgtgcggccctggagtacctccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451473 - DNA, 5877 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagatagggaacactcatccctggtcgtctatcccagtgtgtgtttaacattcacagcccagaaccacagatgtgtctgggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451474 - DNA, 6194 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgaccctggacagcagttcacgtgggagaattcaaacctggaggtgaacaagcccaagaaccgctatgcgaatgtcatcgcctacgaccactctcgagtcatccttacctctatcgatggcgtccccgggagtgactacatcaatgccaactacatcgatggctaccgcaagcagaatgcctacatcgccacgcagggccccctgcccgagaccatgggcgatttctggagaatggtgtgggaacagcgcacggccactgtggtcatgatgacacggctggaggagaagtcccgggtaaaatgtgatcagtactggccagcccgtggcaccgagacctgtggccttattcaggtgaccctgttggacacagtggagctggccacatacactgtgcgcaccttcgcactccacaagagtggctccagtgagaagcgcgagctgcgtcagtttcagttcatggcctggccagaccatggagttcctgagtacccaactcccatcctggccttcctacgacgggtcaaggcctgcaaccccctagacgcagggcccatggtggtgcactgcagcgcgggcgtgggccgcaccggctgcttcatcgtgattgatgccatgttggagcggatgaagcacgagaagacggtggacatctatggccacgtgacctgcatgcgatcacagaggaactacatggtgcagacggaggaccagtacgtgttcatccatgaggcgctgctggaggctgccacgtgcggccacacagaggtgcctgccctgcaacaagttcaagaaccggctggtgaacatcatgccctacgaattgacccgtgtgtgtctgcagcccatccgtggtgtggagggctctgactacatcaatgccagcttcctggatggttatagacagcagaaggcctacatagctacacaggggcctctggcagagagcaccgaggacttctggcgcatgctatgggagcacaattccaccatcatcgtcatgctgaccaagcttcgggagatgggcagggagaaatgccaccagtactggccagcagagcgctctgctcgctaccagtactttgttgttgacccgatggctgagtacaacatgccccagtatatcctgcgtgagttcaaggtcacggatgcccgggatgggcagtcaaggacaatccggcagttccagttcacagactggccagagcagggcgtgcccaagacaggcgagggattcattgacttcatcgggcaggtgcataagaccaaggagcagtttggacaggatgggcctatcacggtgcactgcagtgctggcgtgggccgcaccggggtgttcatcactctgagcatcgtcctggagcgcatgcgctatgagggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaa

SEQ ID NO: 451475 - DNA, 4327 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccaggaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaagtgtttgccaagaacttccgggtggcggctgcaatgaagacgtctgtgctgctcagctgggaggttcccgactcctataagtcagctgtgccctttaagattctgtacaatgggcagagtgtggaggtggacgggcactcgatgcggaagctgatcgcagacctgcagcccaacacagagtactcgtttgtgctgatgaaccgtggcagcagcgcagggggcctgcagcacctggtgtccatccgcacagcccccgacctcctgcctcacaagccgctgcctgcctctgcctacatagaggacggccgcttcgatctctccatgccccatgtgcaagacccctcgcttgtcaggtggttctacattgttgtggtacccattgaccgtgtgggcgggagcatgctgacgccaaggtggagcacacccgaggaactggagctggacgagcttctagaagccatcgagcaaggcggagaggagcagcggcggcggcggcggcaggcagaacgtctgaagccatatgtggctgctcaactggatgtgctcccggagacctttaccttgggggacaagaagaactaccggggcttctacaaccggcccctgtctccggacttgagctaccagtgctttgtgcttgcctccttgaaggaacccatggaccagaagcgctatgcctccagcccctactcggatgagatcgtggtccaggtgacaccagcccagcagcaggaggagccggagatgctgtgggtgacgggtcccgtgctggcagtcatcctcatcatcctcattgtcatcgccatcctcttgttcaaaaggaaaaggacccactctccgtcctctaaggatgagcagtcgatcggactgaaggactccttgctggcccactcctctgaccctgtggagatgcggaggctcaactaccagaccccaggtatgcgagaccacccacccatccccatcaccgacctggcggacaacatcgagcgcctcaaagccaacgatggcctcaagttctcccaggagtatgagtccatcgacctgacagcatctccgcttgaaaggtacgactcat

SEQ ID NO: 451476 - DNA, 2062 bp, Homo sapiens
  misc_feature (18)..(18): n is a, c, g, or t
  misc_feature (1793)..(1793): n is a, c, g, or t
  misc_feature (1977)..(1977): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgaggtaaggactcaggcagtgcctggcccctgtcaccacagagctgtgctgcacctgccgggctctctgcccagagcccttggtgcagacacgcaagggactgccatgggcccagtctcttctccttcctgcttctttctgcagcagcagcaacagctcccactgggcaagttcctggcgtctgccactacttcgccttccttccttgcaggcccatggggaagcagccactcttgggagcatttgtatcttttgtaggtcttgccgcatgggcccggagccccatgggaatttggagccatccaatccgacttcttggtgtatgtgcatgtgtgtgtgcacacacgggcacacttatctgtgtgtaaatgcatgcatacctggcctggctttccttcagtacatcctcctgcctgccgcagcatggtgggctccagaaccaccatggctctgggctttggggtagtaaggcctcaggaacggaccaggccaggtgagcctatcctctggccaggtcttcctggagccttcctggaggaacccttgtgttcagctgtgagcccctgtggttatgttgcctcgggtgagcacctggtgtgttccagatgttctttgctgggagcgagtggacagtgtgctttctggaagtccaagttcccagcagagaggaacctggggactgttttggggtttccaatctctgctatgctcacagcctaggggtgactaaagctggccaccttgccctttcctgagaacacactgggtctggtatacatgtgcccagaaggggccctgagagccccttctaccctcatactgtcccctcacctagccttcttgtacagatggatgtcattaaaagttaaactgttgnccgggtgtggtggctcacgcctgtaatcccagcactttgggaggctgaggcaggcagatcacgaggtcaggagatcgagaccatcctggccaacatggtgaaaccccgtctctactaaaactacaaaaattagctgggcgtggtggcgcgtgcctgtaatcccagctactcaggaggctgaggnaggaaaatcgcttgaaccagaggttgcagtgagccaaggtcgcgccactgcactccagcttggtgaaagagcaagactccatctc

SEQ ID NO: 451477 - DNA, 3664 bp, Homo sapiens
  misc_feature (18)..(18): n is a, c, g, or t
atgtcggtactgcatttntccatggctatcaggaggcggcggcggcagaggagtgggagcagcggccctagcggcttgcggggggacatgcggaccgacggcccctggataggcggaaggagtggaggccctggtgcccggcccttggtgctgagtatccagcaagagtgaccggggtgaagaagcaaagactcggttgattgtcctgggctgtggctggctgtggagctagagccctggatggcccctgagccagccccagggaggacgatggtgccccttgtgcctgcactggtgatgcttggtttggtggcaggcgcccatggtgacagcaaacctgtcttcattaaagtccctgaggaccagactgggctgtcaggaggggtagcctccttcgtgtgccaagctacaggagaacccaagccgcgcatcacatggatgaagaaggggaagaaagtcagctcccagcgcttcgaggtcattgagtttgatgatggggcagggtcagtgcttcggatccagccattgcgggtgcagcgagatgaagccatctatgagtgtacagctactaacagcctgggtgagatcaacactagtgccaagctctcagtgctcgaagaggaacagctgccccctgggttcccttccatcgacatggggcctcagctgaaggtggtggagaaggcacgcacagccaccatgctatgtgccgcaggcggaaatccagaccctgagatttcttggttcaaggacttccttcctgtagaccctgccacgagcaacggccgcatcaagcagctgcgttcaggtgccttgcagatagagagcagtgaggaatccgaccaaggcaagtacgagtgtgtggcgaccaactcggcaggcacacgttactcagcccctgcgaacctgtatgtgcgagtgcgccgcgtggctcctcgtttctccatccctcccagcagccaggaggtgatgccaggcggcagcgtgaacctgacatgcgtggcagtgggtgcacccatgccctacgtgaagtggatgatgggggccgaggagctcaccaaggaggatgagatgccagttggccgcaacgtcctggagctcagcaatgtcgtacgctctgccaactacacctgtgtggccatctcctcgctgggcatgatcgaggccacagcccaggtcacagtgaaagctcttccaaagcctccgattgatcttgtggtgacagagacaactgccaccagtgtcaccctcacctgggactctgggaactcggagcctgtaacctactatggcatccagtaccgcgcagcgggcacggagggcccctttcaggaggtggatggtgtggccaccacccgctacagcattggcggcctcagccctttctcggaatatgccttccgcgtgctggcggtgaacagcatcgggcgagggccgcccagcgaggcagtgcgggcacgcacgggagaacaggcgccctccagcccaccgcgccgcgtgcaggcacgcatgctgagcgccagcaccatgctggtgcagtgggagcctcccgaggagcccaacggcctggtgcggggataccgcgtctactatactccggactcccgccgccccccgaacgcctggcacaagcacaacaccgacgcggggctcctcacgaccgtgggcagcctgctgcctggcatcacctacagcctgcgcgtgcttgccttcaccgccgtgggcgatggccctcccagccccaccatccaggtcaagacgcagcagggagtgcctgcccagcccgcggacttccaggccgaggtggagtcggacaccaggatccagctctcgtggctgctgccccctcaggagcggatcatcatgtatgaactggtgtactgggcggcagaggacgaagaccaacagcacaaggtcaccttcgacccaacctcctcctacacactagaggacctgaagcctgacacactctaccgcttccagctggctgcacgctcggatatgggggtgggcgtcttcacccccaccattgaggcccgcacagcccagtccaccccctccgcccctccccagaaggtgatgtgtgtgagcatgggctccaccacggtccgggtaagttgggtcccgccgcctgccgacagccgcaacggcgttatcacccagtactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacgtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactccccatcatccaagacgtcatgctagccgaggcccagtggcggccagaggagtccgaggactatgaaaccactatcagcggcctgaccccggagaccacctactccgttactgttgctgcctataccaccaagggggatggtgcccgcagcaagcccaaaattgtcactacaacaggtgcagtcccaggccggcccaccatgatgatcagcaccacggccatgaacactgcgctgctccagtggcacccacccaaggaactgcctggcgagctgctgggctaccggctgcagtactgccgggccgacgaggcgcggcccaacaccatagatttcggcaaggatgaccagcacttcacagtcaccggcctgcacaaggggaccacctacatcttccggcttgctgccaagaaccgggctggcttgggtgaggagttcgagaaggagatcaggacccccgaggacctgcccagcggcttcccccaaaacctgcatgtgacaggactgaccacgtctaccacagaactggcctgggacccgccagtgctggcggagaggaacgggcgcatcatcagctacaccgtggtgttccgagacatcaacagccaacaggagctgcagaacatcacgacagacacccgctttacccttactggcctcaagccagacaccacttacgacatcaaggtccgcgcatggaccagcaaaggctctggcccactcagccccagcatccagtcccggaccatgccggtggagcaaggtgtgtgctgtggacatggcatcccttcccgagtgtggctgcatctgggggtctctgctctccttgagccactgacctctggcgactgtgatccaccagcctctggtgtgtgacctccaatctctcatgactgtgaccactaacctctagtgaatgggcaccacattcttgatgcctgacctctgctgtccttaacctactgacctctgctgtatgaccttctgatctcttgtgacctcgccctacttcggctttttcaccgcgcgctgcacccactgacctgcgcccactgtctggcactccctagtgagatgaacctggtacctcagatggaaatgcagaaatcattcatcttctgcatcccctcacgctgagcctgtagaccag

SEQ ID NO: 451478 - DNA, 544 bp, Homo sapiens
  misc_feature (28)..(28): n is a, c, g, or t
tctagaggatcctctatacacctatacnacacaccttaaaacacacagaatagcaatggctgcggagcgcaagacatgctggtagtgggttttaaggtgtggtggagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451479 - DNA, 3693 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451480 - DNA, 3696 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgtccgggccggccccaagggcgtagcagtgagcgcgtcggtggaccgagagataagaggccgcggagcggctggcgcacaaggcaataggtgcagggctcggagcccgcgcagcctgcgccgtgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451481 - DNA, 3640 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggagatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451482 - DNA, 3925 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataaaaagtattaatatgtaagagctttctttttaaacaggaatgtcttagctttctagcttcccagctaaccatgtctgccattccccaggtcttggcatggtgggggaggacttggagagctggcagagccagagttcagaagagcctgcgtcctctcagcccgtatatattttataagcaagttcttctaatgaaagaaagtaattatttggactgtcaagggcattagttag

SEQ ID NO: 451483 - DNA, 3990 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataaaaaaaaaaaaaaaaaaaaaaaaaaaaaaaaaaaaagggggggcacccctaaaaaaaacgccacctaggggggggaacaaaataaagtgcgaaacacaacgactgctgagcacgaaacaatggggcacaatagagaggacgcgagacaagaaacgaagagaagacgaggaccgatataaaaagagcgagagcgagaaagaaacgacaaagccggagacatgaaggagacgaccaaaaactatggggtggagcaaaaaatcgggaacaatacatcgaagataaagccgaaggagcatga

SEQ ID NO: 451484 - DNA, 3636 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451485 - DNA, 3654 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagcccccccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451486 - DNA, 3647 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451487 - DNA, 3568 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451488 - DNA, 3396 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451489 - DNA, 3430 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451490 - DNA, 2184 bp, Homo sapiens
  misc_feature (1949)..(1950): n is a, c, g, or t
  misc_feature (1952)..(1952): n is a, c, g, or t
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggagggnngntatttgcaggaaatatatgattgaaatagtcaaaagagtgggtgacccggaagagaacggtgccgatcgtgtagcacagtgcaagaaaccttgcagagacacggagcacagtccggataggactgggcgatggccatgacattggcaattagggagcttaatcgcagcggcctttactttatccttttagagggtagccgcagttctttagataaccgtgttgtgggtctgg

SEQ ID NO: 451491 - DNA, 859 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451492 - DNA, 686 bp, Homo sapiens
ggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaaggtaggccagggagcgggcccggccggcagcagccgttgtagttcttggactttgcctctgtccccaggttctgggggacgcccctcccgccctgcctttcaggtcgggaaagtcccggggtttgcaaaagagtgtccgagcgccctggaggcggggagggcggcaaggagggcgccggtgtcgcggttgagtttctccactgccgaccgcggccacgctgcccggggcttcccggacaggcttcgcgccgcccacctcggcagccggggcggaggatcacgtgtcgaaacccagcgcggcccacggtgggcgtcctcccctctcccgctccgtccagcaagatcttgctggttttgcgcgtgtataggtggagggtggaggccgagtcgggatccgccaagagtg

SEQ ID NO: 451493 - DNA, 3555 bp, Homo sapiens
gacaaaaacaacatgaaaacaacacatggcgggggaacttaggctaggttagcgaggccggggtgaatcggccgagggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451494 - DNA, 3639 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451495 - DNA, 3511 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451496 - DNA, 3868 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataaaaagtattaatatgtaagagctttctttttaaacaggaatgtcttagctttctagcttcccagctaaccatgtctgccattccccaggtcttggcatggtgggggaggacttggagagctggcagagccagagttcagaagagcctgcgtcctctcagcccgtatatattttataagcaagttcttctaatgaaagaaagtaattatttggactgtcaagggcattagttag

SEQ ID NO: 451497 - DNA, 3824 bp, Homo sapiens
  misc_feature (3368)..(3368): n is a, c, g, or t
  misc_feature (3486)..(3486): n is a, c, g, or t
  misc_feature (3494)..(3494): n is a, c, g, or t
  misc_feature (3525)..(3525): n is a, c, g, or t
  misc_feature (3540)..(3540): n is a, c, g, or t
  misc_feature (3558)..(3558): n is a, c, g, or t
  misc_feature (3565)..(3565): n is a, c, g, or t
  misc_feature (3573)..(3573): n is a, c, g, or t
  misc_feature (3594)..(3594): n is a, c, g, or t
  misc_feature (3605)..(3606): n is a, c, g, or t
  misc_feature (3621)..(3622): n is a, c, g, or t
  misc_feature (3643)..(3644): n is a, c, g, or t
  misc_feature (3678)..(3679): n is a, c, g, or t
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccacgttcatactataaataccaagattgttttcctaataacatatgtttcttnggtaacacactactagaatcaacataagctgaacaccaacgttcttatctttgacggactaggcaagtacggataggattctctacggtttgctttaaaaccttttaacgcaacctgngttgccangttacgtcatcaacacactcgacgtgtcacnttgacattgtgactngttatgacgctggcgctngctgcangtttggcnatttccctacttcatcctcangtgagcttcanngcacaggttcggaanncctcccaaccggccaaaatgnncaggcctgaggacgggttcaatcactgcagtaannattcgtcgatgcgcaaacatccccaaggttggaaatactaaaagatcctccttggtattcttcaggcaacaattttccatctcttgctttctttaatagagcctttacagagtcagcaatttcctggatacctttagcagcagca

SEQ ID NO: 451498 - DNA, 3615 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagcccccccctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451499 - DNA, 3575 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcaccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451500 - DNA, 2999 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagctgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451501 - DNA, 1778 bp, Homo sapiens
agcagccgttgtagttcttggactttgcctctgtccccaggttctgggggacgcccctcccgccctgcctttcaggtcgggaaagtcccggggtttgcaaaagagtgtccgagcgccctggaggcggggagggcggcaaggagggcgccggtgtcgcggttgagtttctccactgccgaccgcggccacgctgcccggggcttcccggacaggcttcgcgccgcccacctcggcagccggggcggaggatcacgtgtcgaaacccagcgcggcccacggtgggcgtcctcccctctcccgctcctccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtgggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataa

SEQ ID NO: 451502 - DNA, 1091 bp, Homo sapiens
agcggagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaataaaaagtattaatatgtaagagctttctttttaaacaggaatgtcttagctttctagcttcccagctaaccatgtctgccattccccaggtcttggcatggtgggggaggacttggagagctggcagagccagagttcagaagagcctgcgtcctctcagcccgtatatattttataagcaagttcttctaatgaaagaaagtaattatttggactgtcaagggcattagttag

SEQ ID NO: 451503 - DNA, 2360 bp, Homo sapiens
gcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaa

SEQ ID NO: 451504 - DNA, 3057 bp, Homo sapiens
  misc_feature (2214)..(2214): n is a, c, g, or t
gcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagaggatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaaaaaaacacaacaaaaaaaaaaaaaaaaaaaaaaaaaaanaaaaaaaaaaaaaaaaaaaaaaaaaaaaaaaaaaaaaaaagggggggggggccaaaaagtacaccccggggggggcaccaaaattaaggagcgcacgccgggttttttagacaaagagggggccccaattaaggaggggcgaaaataataagagggagagaggagcagggccgggggatataaacaacacgggtgggaggggggaaaaacaccgtggctaacgcgagagatcaactcgtagggagagaagaccccccacctaaacagcgcggggggggggagacacacaagtgtgggtgagcacacacccccacccaccaagaagaaatatatgaggcacctcactacgaggagaacacaatataacatcacaaccacgagggcgtacacaacacgggcgtgtgaaaacaagcagagatgagtgaaatataatgcttgactggagtgggtgaggaagaagttgttggtcgaacagtggcgagattgatagtgttggttgaggagagaaattatttaaaggaggggggggatcttgttattaatctataaaatccatggaggggagggcgagaaccgtgccgagccgcgggagacgacggcccgaggcggcgcggggacgacagaccaacgaagggagacgaaacgagggagcgcgcgggcggcgcgagggccgggcgcggcggagaggcgagagcgcagtggggcctctaggggacggagagggcggggcagacgcagggagagggaggacgggagagacgaagacggcgtcgggagcagacaagagacacgaaaagcaacagacacgaacgagccagaagcggagcaaaggaaacagaggag

SEQ ID NO: 451505 - DNA, 2911 bp, Homo sapiens
  misc_feature (2068)..(2068): n is a, c, g, or t
gcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaatgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaaaaaaacacaacaaaaaaaaaaaaaaaaaaaaaaaaaaanaaaaaaaaaaaaaaaaaaaaaaaaaaaaaaaaaaaaaaaagggggggggggccaaaaagtacaccccggggggggcaccaaaattaaggagcgcacgccgggttttttagacaaagagggggccccaattaaggaggggcgaaaataataagagggagagaggagcagggccgggggatataaacaacacgggtgggaggggggaaaaacaccgtggctaacgcgagagatcaactcgtagggagagaagaccccccacctaaacagcgcggggggggggagacacacaagtgtgggtgagcacacacccccacccaccaagaagaaatatatgaggcacctcactacgaggagaacacaatataacatcacaaccacgagggcgtacacaacacgggcgtgtgaaaacaagcagagatgagtgaaatataatgcttgactggagtgggtgaggaagaagttgttggtcgaacagtggcgagattgatagtgttggttgaggagagaaattatttaaaggaggggggggatcttgttattaatctataaaatccatggaggggagggcgagaaccgtgccgagccgcgggagacgacggcccgaggcggcgcggggacgacagaccaacgaagggagacgaaacgagggagcgcgcgggcggcgcgagggccgggcgcggcggagaggcgagagcgcagtggggcctctaggggacggagagggcggggcagacgcagggagagggaggacgggagagacgaagacggcgtcgggagcagacaagagacacgaaaagcaacagacacgaacgagccagaagcggagcaaaggaaacagaggag

SEQ ID NO: 451506 - DNA, 1312 bp, Homo sapiens
gcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaa

SEQ ID NO: 451507 - DNA, 3242 bp, Homo sapiens
  misc_feature (2399)..(2399): n is a, c, g, or t
gcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaaaaaaacacaacaaaaaaaaaaaaaaaaaaaaaaaaaaanaaaaaaaaaaaaaaaaaaaaaaaaaaaaaaaaaaaaaaaagggggggggggccaaaaagtacaccccggggggggcaccaaaattaaggagcgcacgccgggttttttagacaaagagggggccccaattaaggaggggcgaaaataataagagggagagaggagcagggccgggggatataaacaacacgggtgggaggggggaaaaacaccgtggctaacgcgagagatcaactcgtagggagagaagaccccccacctaaacagcgcggggggggggagacacacaagtgtgggtgagcacacacccccacccaccaagaagaaatatatgaggcacctcactacgaggagaacacaatataacatcacaaccacgagggcgtacacaacacgggcgtgtgaaaacaagcagagatgagtgaaatataatgcttgactggagtgggtgaggaagaagttgttggtcgaacagtggcgagattgatagtgttggttgaggagagaaattatttaaaggaggggggggatcttgttattaatctataaaatccatggaggggagggcgagaaccgtgccgagccgcgggagacgacggcccgaggcggcgcggggacgacagaccaacgaagggagacgaaacgagggagcgcgcgggcggcgcgagggccgggcgcggcggagaggcgagagcgcagtggggcctctaggggacggagagggcggggcagacgcagggagagggaggacgggagagacgaagacggcgtcgggagcagacaagagacacgaaaagcaacagacacgaacgagccagaagcggagcaaaggaaacagaggag

SEQ ID NO: 451508 - DNA, 3188 bp, Homo sapiens
  misc_feature (2345)..(2345): n is a, c, g, or t
gcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaaaaaaacacaacaaaaaaaaaaaaaaaaaaaaaaaaaaanaaaaaaaaaaaaaaaaaaaaaaaaaaaaaaaaaaaaaaaagggggggggggccaaaaagtacaccccggggggggcaccaaaattaaggagcgcacgccgggttttttagacaaagagggggccccaattaaggaggggcgaaaataataagagggagagaggagcagggccgggggatataaacaacacgggtgggaggggggaaaaacaccgtggctaacgcgagagatcaactcgtagggagagaagaccccccacctaaacagcgcggggggggggagacacacaagtgtgggtgagcacacacccccacccaccaagaagaaatatatgaggcacctcactacgaggagaacacaatataacatcacaaccacgagggcgtacacaacacgggcgtgtgaaaacaagcagagatgagtgaaatataatgcttgactggagtgggtgaggaagaagttgttggtcgaacagtggcgagattgatagtgttggttgaggagagaaattatttaaaggaggggggggatcttgttattaatctataaaatccatggaggggagggcgagaaccgtgccgagccgcgggagacgacggcccgaggcggcgcggggacgacagaccaacgaagggagacgaaacgagggagcgcgcgggcggcgcgagggccgggcgcggcggagaggcgagagcgcagtggggcctctaggggacggagagggcggggcagacgcagggagagggaggacgggagagacgaagacggcgtcgggagcagacaagagacacgaaaagcaacagacacgaacgagccagaagcggagcaaaggaaacagaggag

SEQ ID NO: 451509 - DNA, 2895 bp, Homo sapiens
  misc_feature (2052)..(2052): n is a, c, g, or t
gcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaaccgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaaaaaaacacaacaaaaaaaaaaaaaaaaaaaaaaaaaaanaaaaaaaaaaaaaaaaaaaaaaaaaaaaaaaaaaaaaaaagggggggggggccaaaaagtacaccccggggggggcaccaaaattaaggagcgcacgccgggttttttagacaaagagggggccccaattaaggaggggcgaaaataataagagggagagaggagcagggccgggggatataaacaacacgggtgggaggggggaaaaacaccgtggctaacgcgagagatcaactcgtagggagagaagaccccccacctaaacagcgcggggggggggagacacacaagtgtgggtgagcacacacccccacccaccaagaagaaatatatgaggcacctcactacgaggagaacacaatataacatcacaaccacgagggcgtacacaacacgggcgtgtgaaaacaagcagagatgagtgaaatataatgcttgactggagtgggtgaggaagaagttgttggtcgaacagtggcgagattgatagtgttggttgaggagagaaattatttaaaggaggggggggatcttgttattaatctataaaatccatggaggggagggcgagaaccgtgccgagccgcgggagacgacggcccgaggcggcgcggggacgacagaccaacgaagggagacgaaacgagggagcgcgcgggcggcgcgagggccgggcgcggcggagaggcgagagcgcagtggggcctctaggggacggagagggcggggcagacgcagggagagggaggacgggagagacgaagacggcgtcgggagcagacaagagacacgaaaagcaacagacacgaacgagccagaagcggagcaaaggaaacagaggag

SEQ ID NO: 451510 - DNA, 4792 bp, Homo sapiens
ggcttgtgtctcctctcttgctcttgatacatgtggactttttgcctttcctctctctcctcatttcagtgaagagagaagtcagaaatatggaatatattatttttctatgaagtgagattatactatacatgtaccttcaggctctataaaactcactaaaattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagcaaacatgctgaagacatatttggtgagttgtttaatgaggctaacaacttctacatcagagcaaattctcttcaagacagaattgatcgccttgctgtcaaagtcacccagctggattcaacagtggaagaggtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagctcctcctcacccaccctccaccgggctcctggtcacagccccgccacccccgggcccaccacctcccccgccaggccctcctggtcccgggtcttctctttcgtcctccccaatgcatggccccccagtagctgaggcgaagcggcaagagcctgcacagccaccaatcagtgatgctcgaagcgacctcctcgctgctattcgaatgggaattcaactgaaaaaggtgcaggagcagcgggagcaggaggcccaagcgggagccagtggtgaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctctctttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaaaaggttttgcttattaataacag

SEQ ID NO: 451511 - DNA, 3261 bp, Homo sapiens
  misc_feature (10)..(10): n is a, c, g, or t
agatacttcngcttgagctgcttcgggagtcgcgatgcaagcgggagccagtggtgaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctctctttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaaaaggttttgcttattaataacag

SEQ ID NO: 451512 - DNA, 4414 bp, Homo sapiens
cacagaaatgtacacttaaaaatgatcaaaaaggtaaattttatgttgtatatattttcctactctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagctcctcctcacccaccctccaccgggctcctggtcacagccccgccacccccgggcccaccacctcccccgccaggccctcctggtcccgggtcttctctttcgtcctccccaatgcatggccccccagtagctgaggcgaagcggcaagagcctgcacagccaccaatcagtgatgctcgaagcgacctcctcgctgctattcgaatgggaattcaactgaaaaaggtgcaggagcagcgggagcaggaggcccaagcgggagccagtggtgaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctctctttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaaaaggttttgcttattaataacag

SEQ ID NO: 451513 - DNA, 3299 bp, Homo sapiens
  misc_feature (66)..(66): n is a, c, g, or t
  misc_feature (73)..(73): n is a, c, g, or t
gtgattgtatgctgtatctgaggttcacgcgggaatatttggggctatgcatgtcttcgggagttngatggcnggcaagcgggagccagtggtgaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctctctttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaaaaggttttgcttattaataacag

SEQ ID NO: 451514 - DNA, 1244 bp, Homo sapiens
aggcggcgtcgctcgcgccgctgcgtgcggtgtggtgcgaggcgggtgcgccgggcggccgcggcgcggcgggaccatggagctcagagcgcagccccggcgccggcggcgggaccgcggaccgttttagttttgattgctgttaactactactgataactgagccaaagtggtgatgctacttgaggggaatttctgcaacccatagtcaacgattacatgattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagcaaacatgctgaagacatatttggtgagttgtttaatgaggctaacaacttctacatcagagcaaattctcttcaagacagaattgatcgccttgctgtcaaagtcacccagctggattcaacagtggaagaggtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtgtgtgtgtgtcactgctccctcagccctgatgcttgggcaactgggtactacctggttttattatcatttgaaatgcatcaatagcttcggggtttatatggcccttgatgtcttaagattttccttaaaaattgtttatctgtattttgattttgaaataatacttgaagacagtgttattttacattgggttcctttgattttagaaaatctctctgacttaaaatgtattgttgagttcatctagatgtagtgttttaacactgattctgaatttggggtaactgcttatg

SEQ ID NO: 451515 - DNA, 443 bp, Homo sapiens
cagtcagctgctttattctgcctttcttcaggaagtgctgcactttttgagtggtcctccttttggcacatttcagtagcagatcttgacttctgtcataatgaataatgtcaaactgtgaaaataactgacccaaggtgtgcatgtttgcatcctgccatgattgaagttcaggtgacaatacgtgttgtgtctggggatggctccgttaggtgtctaagagctcccaggacgtgaccctctcttgttcccttggtgactatgtgcctcatatctctctcaggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagct

SEQ ID NO: 451516 - DNA, 4851 bp, Homo sapiens
aggcggcgtcgctcgcgccgctgcgtgcggtgtggtgcgaggcgggtgcgccgggcggccgcggcgcggcgggaccatggagctcagagcgcagccccggcgccggcggcgggaccgcggaccgttttagttttgattgctgttaactactactgataactgagccaaagtggtgatgctacttgaggggaatttctgcaacccatagtcaacgattacatgattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagcaaacatgctgaagacatatttggtgagttgtttaatgaggctaacaacttctacatcagagcaaattctcttcaagacagaattgatcgccttgctgtcaaagtcacccagctggattcaacagtggaagaggtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagctcctcctcacccaccctccaccgggctcctggtcacagccccgccacccccgggcccaccacctcccccgccaggccctcctggtcccgggtcttctctttcgtcctccccaatgcatggccccccagtagctgaggcgaagcggcaagagcctgcacagccaccaatcagtgatgctcgaagcgacctcctcgctgctattcgaatgggaattcaactgaaaaaggtgcaggagcagcgggagcaggaggcccaagcgggagccagtggtgaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctctctttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaaaaggttttgcttattaataacag

SEQ ID NO: 451517 - DNA, 3518 bp, Homo sapiens
aggcggcgtcgctcgcgccgctgcgtgcggtgtggtgcgaggcgggtgcgccgggcggccgcggcgcggcgggaccatggagctcagagcgcagccccggcgccggcggcgggaccgcggaccgttttagttttgattgctgttaactactactgataactgagccaaagtggtgatgctacttgaggggaatttctgcaacccatagtcaacgattacatgattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagcaaacatgctgaagacatatttggtgagttgtttaatgaggctaacaacttctacatcagagcaaattctcttcaagacagaattgatcgccttgctgtcaaagtcacccagctggattcaacagtggaagaggtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtcacatgcatcggacgttacggattactcttacccggctactcccaaccattcttctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctggtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctctctttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaaaaggttttgcttattaataacag

SEQ ID NO: 451518 - DNA, 794 bp, Homo sapiens
aggcggcgtcgctcgcgccgctgcgtgcggtgtggtgcgaggcgggtgcgccgggcggccgcggcgcggcgggaccatggagctcagagcgcagccccggcgccggcggcgggaccgcggaccgttttagttttgattgctgttaactactactgataactgagccaaagtggtgatgctacttgaggggaatttctgcaacccatagtcaacgattacatgattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagcaaacatgctgaagacatatttggtgagttgtttaatgaggctaacaacttctacatcagagcaaattctcttcaagacagaattgatcgccttgctgtcaaagtcacccagctggattcaacagtggaagaggtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaaggtaaataatttcagtatgggaa

SEQ ID NO: 451519 - DNA, 5821 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaaaaaaaaaaaaggggggggtaaaaaacccgaggggcaagttaggtaccagttttggcaaagggccaaagggggaaaaaaaagaggggggtaaaagggggaagtggt

SEQ ID NO: 451520 - DNA, 5717 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtgtggggggggggggggggagaggggggggtggggggggggggggttgcagaacactcttttttaatatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451521 - DNA, 5792 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgctcatttgtattctagatttctgatagatcccttcttccctaatatgatccctaatatgatcttctcgttttcaggccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451522 - DNA, 5716 bp, Homo sapiens
ggcccgggcatctctctggccgcccgtgacgggtgaagctctggggctgcggtcaggccggcgaccggcttgggagcccatattctccattcccggttccggggtgatcgtggagaggcggaagccccttctggtgctagtagtgaacctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451523 - DNA, 4603 bp, Homo sapiens
taatgtttccaaacttttaagtcttatagttgttattttattcattaatggcataccacggatatttatttttcccttgacagaataactatattcaacagaataacttgttaaaaatcggcccgtttcctattatggaagatttaggtcatttccatgttataaataatattgaggtgattattttggagtataaaacaagaatgtttatattatgatctattacctaacaaataattttgctcattatatagtaaattgtgttttatcacaaggctataaacagcatgttcaagttagtatatttgaggttgaactaaatgtgctaatattaatatgtatatttttattttagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451524 - DNA, 3028 bp, Homo sapiens
ccggcagaagatgaggccaggacgtgtaacatcctggggaggccacagttaaatgaaacccaagggcaggccatggggtgccccaggctccaacctcccctgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451525 - DNA, 5059 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451526 - DNA, 4889 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggtcaagaagatggcggaactagaaggcctaaaacaaagattagaaaagaaacagaaaagagaaccaggtacaaagacaaagaaacaaactacattggcatttaagccaatcaaaaaaaa

SEQ ID NO: 451527 - DNA, 3846 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaag

SEQ ID NO: 451528 - DNA, 1056 bp, Homo sapiens
agttccttgacttacagtggcgcaacagctttctttcgagttgcgggatataagtcacccgcgtcgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451529 - DNA, 2617 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgctcatttgtattctagatttctgatagatcccttcttccctaatatgatccctaatatgatcttctcgttttcaggccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaag

SEQ ID NO: 451530 - DNA, 325 bp, Homo sapiens
actttatggtaatcatgataacagaacaatgaatatagaataaaaataacagtatttctttgccttatttctagcaaatgtgggtttacgatgaagatgttggcattaactatagggaagtcacttttgttcctggtttgtacaaaatctttgatgagattctaggtgagtaaatcctttaatataaagatctggtcaaatctttcataagaagtatcattccaaataaaaatttaaaaaagataaaagtaaaaacaaaaagtatcatttctaccaaacctgctgtagccagggctcctgtcatttcaatcagttgataaaggtg

SEQ ID NO: 451531 - DNA, 5716 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451532 - DNA, 6098 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaaaaaaaaaaaaaaaaaaaaaaaaaaaaaaaaaaaaagaaaaaaaaaacaaaaaaaaaaaaaaagaaaaacaaaaaaaaaagaaaaacaaaaaacacaacataaaacagcaagacaataaaacgcaaagaaaaaaaagaaaacgcacaacaaaaacgcaacacaacaggagggggggggaggagtcgagataaacgggacggggaacaagcaaagtccaacaggctagcggacaaagggaggaggagaccaccagccgggaggcgaccacaagcactgaggcagcaagcagagcacgacgaaaacagaagagaacaagcagaggcacacaaacacaccgcacacgcaaacaggacaaggaaacacaaacacaccgacgccaaac

SEQ ID NO: 451533 - DNA, 5661 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451534 - DNA, 5659 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaataattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451535 - DNA, 5670 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451536 - DNA, 2950 bp, Homo sapiens
ctgagatttcaatggttgtagaattaagaatagctacttcaccactaatcacagagcttccatgttctgacgggaagctctgagatttcaatggttgtagaattaagaatagctacttcaccactaatcacagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451537 - DNA, 1928 bp, Homo sapiens
aaggatccccctcctatctgaatccagatgtaagaaagaagaaaaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaa

SEQ ID NO: 451538 - DNA, 3501 bp, Homo sapiens
  misc_feature (3328)..(3328): n is a, c, g, or t
  misc_feature (3333)..(3334): n is a, c, g, or t
  misc_feature (3337)..(3337): n is a, c, g, or t
  misc_feature (3341)..(3341): n is a, c, g, or t
  misc_feature (3351)..(3351): n is a, c, g, or t
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattggaatangctannaanattnattaagtcgnttcagaggggaatgatcggaccgtgaaggctggaagaagccgcaaagtccatgagaaaaatggggggggcgaggaatgaagaggtcggaattgggactcattttgggtctggttaagaaaagaatggtgagaaaaaagggttaaaaaatg

SEQ ID NO: 451539 - DNA, 2404 bp, Homo sapiens
  misc_feature (2395)..(2396): n is a, c, g, or t
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgctcatttgtattctagatttctgatagatcccttcttccctaatatgatccctaatatgatcttctcgttttcaggccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacccaggaggaactattccccttctattgggggggaatgggttttggaaaaccccgggttcnnaaaaaaaa

SEQ ID NO: 451540 - DNA, 768 bp, Homo sapiens
caccctgcctttgttactgggaaaccgaacgcggcgctgtggctttcagcttggatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaa

SEQ ID NO: 451541 - DNA, 3175 bp, Homo sapiens
  misc_feature (1)..(2): n is a, c, g, or t
  misc_feature (8)..(8): n is a, c, g, or t
  misc_feature (3106)..(3106): n is a, c, g, or t
  misc_feature (3138)..(3138): n is a, c, g, or t
  misc_feature (3146)..(3146): n is a, c, g, or t
  misc_feature (3156)..(3156): n is a, c, g, or t
  misc_feature (3158)..(3158): n is a, c, g, or t
  misc_feature (3163)..(3163): n is a, c, g, or t
  misc_feature (3175)..(3175): n is a, c, g, or t
nngctcanacttgataacacccgtggtgccccatccctataggagctggtgagattgcagcctgctgcctcccctccatcaaccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagcaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgnggaggatggggcttagatagtatcgaatgacnattactgngaaaaacttnanaaaanagcgagggggcn

SEQ ID NO: 451542 - DNA, 4890 bp, Homo sapiens
  misc_feature (914)..(914): n is a, c, g, or t
  misc_feature (1034)..(1034): n is a, c, g, or t
  misc_feature (1142)..(1142): n is a, c, g, or t
  misc_feature (2224)..(2224): n is a, c, g, or t
  misc_feature (2362)..(2362): n is a, c, g, or t
  misc_feature (2515)..(2515): n is a, c, g, or t
  misc_feature (2561)..(2561): n is a, c, g, or t
  misc_feature (3149)..(3149): n is a, c, g, or t
  misc_feature (4227)..(4227): n is a, c, g, or t
ctgggtgtgcaggtgcgattgcagtccgagctcccacacaggtgctggggctgtgctgccaccagcttggattttcattgtttgaaattgcactttaaatactttaaataaaatctccttggcattttcacttttgtaaaaaaaaaaaaaaaaaaaaaccgcttggatgccagccagcctcgccctgggagcaggtattgcattttcctcccgcttcattcctgatcagagattattcatttatgaatgggtggctgtaaaaacttgcctcatgcatatgaaaattgaacctggaaatttttaattgctgtgagttttgcttttacaaaaaacgctttggcaatgggtggcaggcaatgggtggaaggacaaattctctttattttcttcctaaatttactctgtgatctgcactttccaatgacatttgtccaagaggcactgactgaacaggctgtttgatcccctaacagatcatgattctggaaggaggtggtgtaatgaatctcaaccccggcaacaacctccttcaccagccgccagcctggacagacagctactccacgtgcaatggtaagagggcctgtgggtgttggtgtcactgctgtgctgtgtgggctctttgctttaattcctctcacaacctaatgtttgaaaaatataggctttacagcagaagatgtgggacaagaaggaatggagaaaactcagttttggagttccctaccagcccccagcgttccagacaaaagctcgtttgagatattctattgcctcctcccaaaattcaaggttccagattgacagcctggcagtgaaggggggtagaagagatgcctaaaggaaagactctctgttggagcttttaatagtgttttgctgggatatcaagataggctaggagagaaagggtntgtgtgtgtgtgtgtgtgtgtgtgtgtgtatgtgcgcgtgcatggaggttaggaaggagagggttatagcagttcaatctttcttttttcgtcttccagtggcctctctttgcaaggggngaggagatttgtaaggagaacaggtgttctccctagagctttaatctagaacacgtctattagaagaagaggggacctggtggtggggcgtatagagggtttggtgancaagcctgtggcttcctgaatcaagttgaatccctgaatcaagttgaatctctgaatcaagttgttgctgaatcgggaaccccataccccaatttagagctctccagtttaggcattcagctgtgcatccaacagcagtgagtttagggagctctgggcctcttctcaatccacacccactgctaatctgcctgccagaggctctgctgttcaagtttgctttgaaatatggagatggtttgttggtgaccagagcttgggaggaggcagaagtgggaggataatgggagagttattctgcagcgagtgctaatccatgtggagctccacctcttttaatttggaatcctagtcaaacatggttgaaagggtgagcaggtgagcttcccttactcggtcacctgtccccccaaactgctgcactttctgggcagttgcattttctgttgtgggcctcaaataccctgtgaggacccagaaagtggattccaaataaaactggaagtctttggcatccccaggaccctggcctctcgatgaaggcagcatttctcctgcttgctctggagaaagctggggaaatgtgttcagcaggaagtagaactggggtgccacttttatttcttaaattccagagacctcaaagaaagctcagccttgattgagactgaagaggaaaaggagatcagttgaatggcagagaggatgtgaactcataggaatttttattgtttctcctgaaacttcaggaatttggtgggttctctgtctgatgcggaatctccccagtcagcttcagacaaaaatccctgattctcccaagtttgaacaagatacactagcagggactatcttttaatctagaccgtatcaagtttgcagatgagattattctagatgtgctgttaggttattaaaagttggtgcctcttgttgtcaaaaccagagctgtactgtcatagcaacacaattattttagaaaaagaaagatgaaagacttggggagccacaaaatatatatcccatccttaaacagctttatttgtgaggcaccaaaaattgggggaaatggaaagatccancccaaggtctgtgtatttgggactatttccatataattagatttttagattagattgttccattcctcccccaacccctgactattggcttcctctttagagcccacgttgtgggccaggggctgcttttgtttcgcnatgaggtacgaggagctaagtgcatactgtgagtggtgggtattactaacggcagtcacctctgtgtgctagataaacttgacctcctgctcttagtgcttctgaggtctggaagccatggatggattctgaatgaatgaggaagaagagggnttgggtcagaaacatttccctttcagtctctcctctgagggtgttntgggctggaccatgggcattatgggagttaaacctttctgaggcctttagctacttgtaattcgatagaccagcaacatcagcatcacatggaagcttgctaggaatgcagaaactcaggccttgccccagacctgttgaatcagaatcggcatttgaacagtattccctggtgattcacgatcacgtttgagaagaactgatctggcgtgaccttgaagaaaaagttagagacagttttcttgcactacattttcttctactggtccacccttgaatttgttggaatatccatgtgtcacgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcncttcttcattggtatctgaatgtaccatcttgtgaatgtaccatcttttaaatgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggacagtgagcccttgaagcaagttggggggattgggaatgattttacaggatggtcagagttcgaaagatgggtaggaattcaacaggagtgagaggtagaacacaagcttagctgaaagaacagcatagagaaaagacaagttattggttacttgaagaagagttagtgaagagcctcaatgcctagctaggcagctttatacctaatttcagtgggtgatgaggactactaaaggtaactgagtagggaagtgacatcatgatagctataatgactaggctggggcagtgggatatcagtccagttagtagatcaataatctggaccactttgaggaaaagcaaaggcatcgtagagaaaagaaccttaatttcaggccttatttttagttgaaaatggtctgagtttggtggtgtgtgtgtgtgtgtgtgtgtgtgtgtgtgtatgtataagagagaaaaaatgagagagagtgagtgagagagaagaggaagagaacgatttgggtatggacaataagctaataaattgctgaaatgatagcaatgctctagctttcatgatattttactttgggggaggtgggggatgagctctgagcacttcagctctcttgtcctcatccagtgtccaggggtaggtagcaggctagggaggacatgaaaatgcacttctgctccatcacccatgctggcacatacacggactgtggttgtgtctctgagatatctggcagccaacagtacatccctgtgtcagatactanggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaa

SEQ ID NO: 451543 - DNA, 5329 bp, Homo sapiens
  misc_feature (1)..(2): n is a, c, g, or t
  misc_feature (8)..(8): n is a, c, g, or t
nngctcanacttgataacacccgtggtgccccatccctataggagctggtgagattgcagcctgctgcctcccctccatcaaccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagcaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataatgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaaaaaaaaaat

SEQ ID NO: 451544 - DNA, 9448 bp, Homo sapiens
  misc_feature (914)..(914): n is a, c, g, or t
  misc_feature (1034)..(1034): n is a, c, g, or t
  misc_feature (1142)..(1142): n is a, c, g, or t
  misc_feature (2224)..(2224): n is a, c, g, or t
  misc_feature (2362)..(2362): n is a, c, g, or t
  misc_feature (2515)..(2515): n is a, c, g, or t
  misc_feature (2561)..(2561): n is a, c, g, or t
  misc_feature (3149)..(3149): n is a, c, g, or t
  misc_feature (4227)..(4227): n is a, c, g, or t
ctgggtgtgcaggtgcgattgcagtccgagctcccacacaggtgctggggctgtgctgccaccagcttggattttcattgtttgaaattgcactttaaatactttaaataaaatctccttggcattttcacttttgtaaaaaaaaaaaaaaaaaaaaaccgcttggatgccagccagcctcgccctgggagcaggtattgcattttcctcccgcttcattcctgatcagagattattcatttatgaatgggtggctgtaaaaacttgcctcatgcatatgaaaattgaacctggaaatttttaattgctgtgagttttgcttttacaaaaaacgctttggcaatgggtggcaggcaatgggtggaaggacaaattctctttattttcttcctaaatttactctgtgatctgcactttccaatgacatttgtccaagaggcactgactgaacaggctgtttgatcccctaacagatcatgattctggaaggaggtggtgtaatgaatctcaaccccggcaacaacctccttcaccagccgccagcctggacagacagctactccacgtgcaatggtaagagggcctgtgggtgttggtgtcactgctgtgctgtgtgggctctttgctttaattcctctcacaacctaatgtttgaaaaatataggctttacagcagaagatgtgggacaagaaggaatggagaaaactcagttttggagttccctaccagcccccagcgttccagacaaaagctcgtttgagatattctattgcctcctcccaaaattcaaggttccagattgacagcctggcagtgaaggggggtagaagagatgcctaaaggaaagactctctgttggagcttttaatagtgttttgctgggatatcaagataggctaggagagaaagggtntgtgtgtgtgtgtgtgtgtgtgtgtgtgtatgtgcgcgtgcatggaggttaggaaggagagggttatagcagttcaatctttcttttttcgtcttccagtggcctctctttgcaaggggngaggagatttgtaaggagaacaggtgttctccctagagctttaatctagaacacgtctattagaagaagaggggacctggtggtggggcgtatagagggtttggtgancaagcctgtggcttcctgaatcaagttgaatccctgaatcaagttgaatctctgaatcaagttgttgctgaatcgggaaccccataccccaatttagagctctccagtttaggcattcagctgtgcatccaacagcagtgagtttagggagctctgggcctcttctcaatccacacccactgctaatctgcctgccagaggctctgctgttcaagtttgctttgaaatatggagatggtttgttggtgaccagagcttgggaggaggcagaagtgggaggataatgggagagttattctgcagcgagtgctaatccatgtggagctccacctcttttaatttggaatcctagtcaaacatggttgaaagggtgagcaggtgagcttcccttactcggtcacctgtccccccaaactgctgcactttctgggcagttgcattttctgttgtgggcctcaaataccctgtgaggacccagaaagtggattccaaataaaactggaagtctttggcatccccaggaccctggcctctcgatgaaggcagcatttctcctgcttgctctggagaaagctggggaaatgtgttcagcaggaagtagaactggggtgccacttttatttcttaaattccagagacctcaaagaaagctcagccttgattgagactgaagaggaaaaggagatcagttgaatggcagagaggatgtgaactcataggaatttttattgtttctcctgaaacttcaggaatttggtgggttctctgtctgatgcggaatctccccagtcagcttcagacaaaaatccctgattctcccaagtttgaacaagatacactagcagggactatcttttaatctagaccgtatcaagtttgcagatgagattattctagatgtgctgttaggttattaaaagttggtgcctcttgttgtcaaaaccagagctgtactgtcatagcaacacaattattttagaaaaagaaagatgaaagacttggggagccacaaaatatatatcccatccttaaacagctttatttgtgaggcaccaaaaattgggggaaatggaaagatccancccaaggtctgtgtatttgggactatttccatataattagatttttagattagattgttccattcctcccccaacccctgactattggcttcctctttagagcccacgttgtgggccaggggctgcttttgtttcgcnatgaggtacgaggagctaagtgcatactgtgagtggtgggtattactaacggcagtcacctctgtgtgctagataaacttgacctcctgctcttagtgcttctgaggtctggaagccatggatggattctgaatgaatgaggaagaagagggnttgggtcagaaacatttccctttcagtctctcctctgagggtgttntgggctggaccatgggcattatgggagttaaacctttctgaggcctttagctacttgtaattcgatagaccagcaacatcagcatcacatggaagcttgctaggaatgcagaaactcaggccttgccccagacctgttgaatcagaatcggcatttgaacagtattccctggtgattcacgatcacgtttgagaagaactgatctggcgtgaccttgaagaaaaagttagagacagttttcttgcactacattttcttctactggtccacccttgaatttgttggaatatccatgtgtcacgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcncttcttcattggtatctgaatgtaccatcttgtgaatgtaccatcttttaaatgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggacagtgagcccttgaagcaagttggggggattgggaatgattttacaggatggtcagagttcgaaagatgggtaggaattcaacaggagtgagaggtagaacacaagcttagctgaaagaacagcatagagaaaagacaagttattggttacttgaagaagagttagtgaagagcctcaatgcctagctaggcagctttatacctaatttcagtgggtgatgaggactactaaaggtaactgagtagggaagtgacatcatgatagctataatgactaggctggggcagtgggatatcagtccagttagtagatcaataatctggaccactttgaggaaaagcaaaggcatcgtagagaaaagaaccttaatttcaggccttatttttagttgaaaatggtctgagtttggtggtgtgtgtgtgtgtgtgtgtgtgtgtgtgtgtatgtataagagagaaaaaatgagagagagtgagtgagagagaagaggaagagaacgatttgggtatggacaataagctaataaattgctgaaatgatagcaatgctctagctttcatgatattttactttgggggaggtgggggatgagctctgagcacttcagctctcttgtcctcatccagtgtccaggggtaggtagcaggctagggaggacatgaaaatgcacttctgctccatcacccatgctggcacatacacggactgtggttgtgtctctgagatatctggcagccaacagtacatccctgtgtcagatactanggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagcaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataatgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaaaaaaaaaat

SEQ ID NO: 451545 - DNA, 4870 bp, Homo sapiens
tagtacctgtcagtcaatacatgcttccatcatgaacactggaaagagaaactattatatacacacagagcacagtatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagcaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataatgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaaaaaaaaaat

SEQ ID NO: 451546 - DNA, 881 bp, Homo sapiens
ccgtgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagactccaactcaaaaacaaaaaacaacaacaacaaaaaaagccggtcgcatggcacatgtatacatatgtaactaacctgcacaatgtgcacatgtaccctaaaacttagagtataata

SEQ ID NO: 451547 - DNA, 5398 bp, Homo sapiens
  misc_feature (1)..(2): n is a, c, g, or t
  misc_feature (8)..(8): n is a, c, g, or t
nngctcanacttgataacacccgtggtgccccatccctataggagctggtgagattgcagcctgctgcctcccctccatcaaccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagcaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataatgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaaaaaaaaaat

SEQ ID NO: 451548 - DNA, 5458 bp, Homo sapiens
ccgtgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagcaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataatgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaaaaaaaaaat

SEQ ID NO: 451549 - DNA, 5205 bp, Homo sapiens
tctccccgttgcaggatgagtgcagataaccagcagagacacctgtgaactcatttacctaaagattctgggtgggaaatccaatagctgtggctgatggaggggaggcagcaggctgcaatctcaccagctcctatctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagcaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataatgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgtaaattgctatttaagtgtaaagcagttctaagttttagtatttgggggattggtttttattatttttttcctttttgaaaaatactgagggatcttttgataaagttagtaatgcatgttagattttagttttgcaagcatgttgtttttcaaatatatcaagtatagaaaaaggtaaaacagttaagaaggaaggcaattatattattcttctgtagttaagcaaacacttgttgagtgcctgctatgtgcacggcatgggcccatatgtgtgaggagcttgtctaattatgtaggaagcaatagatctcggtagttacgtattgggcagatacttactgtatgaatgaaagaacatcacagtaatcacaatatcagagctgaattatcctcagtgtagcttcttggaattcagtttctggaactagagatagagcatttattaaaaaaaactcctgttgagactgtgtcttatgaacctctgaaacgtacaagccttcacaagtttaactaaattgggattaatctttctgtagttatctgcataattcttgtttttctttccatctggctcctgggttgacaatttgtggaaacaactctattgctactatttaaaaaaaatcagaaatctttccctttaagctatgttaaattcaaactattcctgctattcctgttttgtcaaagaattatatttttcaaaatatgtttatttgtttgatgggtcccaggaaacactaataaaaaccacagagaccagcctggaaaaaaaaaaat

SEQ ID NO: 451550 - DNA, 1978 bp, Homo sapiens
tgtgagctcactcccgcctccatgttcccggagtcgcctggaagcgtccgcccaaggtcgcgggccgcttggggagtcagcagcgcgccaggccccttcgggccccacacgcattaggtgccttcttgatgggtacggagtgaacgcgggcggcggcgggaccgaggcagcgcccagtttgtaaccgccgcgccgcccgtgcccgcgcgcgccacaccccagcgcgcttccggccgggccacgtgaccgcgcgtgcacgtgttccggcctctccgcttcgccgctccgaacctcctcctggtcgtcccggcattcgtccacgcggagccggcttgggcggggcccgggaggcggcggccggagaagccgcggagacgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtggtgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactctgaaagtgggtccgagctaaagtcgact

SEQ ID NO: 451551 - DNA, 396 bp, Homo sapiens
attggtggtgctgtctgtattatcccttccctaggagaaaagagaggcaatgccaagctgcttcatcaactgttaatacttcttccagcccgcaacccaggatatctgcaggtgtctctccctctggtttggtcatggctctctctgttctagaatgtatgggttaaagtcggctgccacaccatgccctcggcagtgtggtccaaggacccctgagggtcctcaaggtccttcctttcccaaccccacgtggttttcttcagtcaggataccatactgcaacagaccgaaggcggaagcagctatgaggatgcagcagccttctgttaagccaggctttaaggatctgcaaaaatgtaaaacgatgccagcaccaccaatacagggtaccgagct

SEQ ID NO: 451552 - DNA, 5930 bp, Homo sapiens
tgtgagctcactcccgcctccatgttcccggagtcgcctggaagcgtccgcccaaggtcgcgggccgcttggggagtcagcagcgcgccaggccccttcgggccccacacgcattaggtgccttcttgatgggtacggagtgaacgcgggcggcggcgggaccgaggcagcgcccagtttgtaaccgccgcgccgcccgtgcccgcgcgcgccacaccccagcgcgcttccggccgggccacgtgaccgcgcgtgcacgtgttccggcctctccgcttcgccgctccgaacctcctcctggtcgtcccggcattcgtccacgcggagccggcttgggcggggcccgggaggcggcggccggagaagccgcggagacgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtggtgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttaggtgtgaagatatgtgtctattggcagatgtccttgaaaactgcataaaacagtatgtgcctggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttttccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttcaaattatctttgtagataagaacagtgtttcttttttcttttcttttgttttttgttgtttgttttgttttgttttgagacagagtttcactcttgttgcccaggctggagtgcaatggcacaatcttgatctcagctcgccgcagcctccgcctcccggttcaagcgattcttctgcctcagcctcccgagtagctgggattacaggcatgcaccaccacgcctggctaatttcgtatttttaatagagacagggtttctccatgttggtcaggctggtctcaaactcctgacttgaggtgatctgcccgccttggcctcccaaagtgctgggattacaggcgggaaccactgcacccggcaggtacagtgtttctttaggtgctggtggtacaccagggaatcagggcagaagctggatcctgcaagagtaatgtttgagaacaaataaatactttcgaaaggaggtcgaaacaaaaaggagtgtaggtgttattactgcagagaagactgaatggagtccacttttcttattagtaacttactaaaaatgatctcaaatgggctccacacactttgccctggccatgaggcaaacttgttgggtttggagaaaaacacataaccctaaattcactatttttgccctatataaaacattaaaataacatgctctgtacacatgctgtcaacaaaagccagctctaggaacctgagtgccagaatgcctgagggagctacagctgggcttagttggctgggattgagctcgctgtctgagggagctcgctctgtctctctcacactggcagtttacaccagccggcagccctgagcagcagtgggtgtaactttttataaataaggattcattgattcattcatattctcaatatttcttgaagacctaccccgagccaagcatggtgccaggcagtggggatgcagtggagagcaaacagccctgcccatgcaaagtgtcctgtacggtgagaagtgtgagctgcacccacaaagggaaagagcccagtgcagcttttgcaaaatgcagggaaggatgctgctagcctcagggtgacctagaactttaagctcatctttgttttcaggagcccagtgcctcccctccacccctaaagaatatctcaaagacgtggattttcatttcagtaagatttaggggtgcatgggcaggcagtgctggaggaactgggaggcaggtttggaggctgcagtgggaccactggcccctcctggctacagtttcaggccaggagcttgttggcacctggtgcaaactcccaaacctgaggggtccccacaaccccccagcccatcttaacctcctcttcccccaagctatctggtgttggaaagccagcatctagtgtggaaacaagctttctcaccaggtaggccatccgctgtcaggaccattaggtaaaaacagaagtgacaggttgtaggaagtcgttcgatctgtgaggctgcgagcacttcagtgcctgggatttacctaactgccatgaaacactgattatccagcattcagcatgtgtcagattctgtaactatttctcctgtgatgtatcagtcagcttttgctgcaaaacagcatcagaaatctcagtggtctacaactagattcccattcttgggtagtctacaagttggcttctaggttatgctccaggctgggggtctgatcacgtctgctccacaacatgtcccgtattctgggtccctggttgaagcagcagcttaccttgggccgtgttctttctcatggcagaagcacaggaggccaagccctaccttgcaagcacaaatacagcccctgctcactttctgttggccacaacacatggccatgcctgacctctgtggggtgaggcagtgcatggccaaggaacaagcacagtccacacagggggctgtcactccgtgacctcagtattacaaaatggttctcaaggagtcgcaaaatgtgtggcagatcatccatgatttgtttcccgtgtgctttacgaatatcctgaaatttttaaaagctgtttccattagaagggatctgttggggatttgaggtgagatgagaaagaccctgcattccagcccctcagttagcagtggtgaggccggagtactccacacgggacagttttaggaaagtgctggaatccaaagtttctccggagggctatgcaaggcgctttggaaaggcgaagcctgggcgcagggagcccagccatgtaggtagaagcagcagacggtgagggaggccatccccacctggccctgccagggccctgactcagtgaaggaagctgttgggatacaggtcattcagccgggcaggaaagatgggatgaagcccagcaagttcacagggatccgggaagttgtgtggctggaaacccaggcagggctgcaccacagggaccatttgctggagatgcagcacttgccacagccaccaccactgacagcatgacacccacaaaaagggagcctccagctgcacccctgctgctgcgagtacttcctcagctgtctgccatgagcttaaggttaagtaccaggagggaggatatgattgggcaaacctcaggcatgtgttcattctgtagcttccagaacatgcgaggagagagcatctggctcctttgtctcgaggaggagggggcaggactctgccagaactcactcgataaaagattttcccaaaaggaagggtgttcagatgacaaaagtccactacaccactttccttggctatctgatgcacccccatcttcccatgcgcgcacctcagaaatcaggctcccacctgacataacacaaccatgcctcacaaaaagacagtggtttatcccttccctaggagaaaagagaggcaatgccaagctgcttcatcaactgttaatacttcttccagcccgcaacccaggatatctgcaggtgtctctccctctggtttggtcatggctctctctgttctagaatgtatgggttaaagtcggctgccacaccatgccctcggcagtgtggtccaaggacccctgagggtcctcaaggtccttcctttcccaaccccacgtggttttcttcagtcaggataccatactgcaacagaccgaaggcggaagcagctatgaggatgcagcagccttctgttaagccaggctttaaggatctgcaaaaatgtaaaacgatgccactcctactgatgaaatatattgttttggaaaatataggtttaaaaatttttttaaggtaacatgtaatggatgtatagtcttcaaatggatgaataaatgtttttcagagtta

SEQ ID NO: 451553 - DNA, 6714 bp, Homo sapiens
tgtgagctcactcccgcctccatgttcccggagtcgcctggaagcgtccgcccaaggtcgcgggccgcttggggagtcagcagcgcgccaggccccttcgggccccacacgcattaggtgccttcttgatgggtacggagtgaacgcgggcggcggcgggaccgaggcagcgcccagtttgtaaccgccgcgccgcccgtgcccgcgcgcgccacaccccagcgcgcttccggccgggccacgtgaccgcgcgtgcacgtgttccggcctctccgcttcgccgctccgaacctcctcctggtcgtcccggcattcgtccacgcggagccggcttgggcggggcccgggaggcggcggccggagaagccgcggagacgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtggtgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttaggtgtgaagatatgtgtctattggcagatgtccttgaaaactgcataaaacagtatgtgcctggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttttccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttcaaattatctttgtagataagaacagtgtttcttttttcttttcttttgttttttgttgtttgttttgttttgttttgagacagagtttcactcttgttgcccaggctggagtgcaatggcacaatcttgatctcagctcgccgcagcctccgcctcccggttcaagcgattcttctgcctcagcctcccgagtagctgggattacaggcatgcaccaccacgcctggctaatttcgtatttttaatagagacagggtttctccatgttggtcaggctggtctcaaactcctgacttgaggtgatctgcccgccttggcctcccaaagtgctgggattacaggcgggaaccactgcacccggcaggtacagtgtttctttaggtgctggtggtacaccagggaatcagggcagaagctggatcctgcaagagtaatgtttgagaacaaataaatactttcgaaaggaggtcgaaacaaaaaggagtgtaggtgttattactgcagagaagactgaatggagtccacttttcttattagtaacttactaaaaatgatctcaaatgggctccacacactttgccctggccatgaggcaaacttgttgggtttggagaaaaacacataaccctaaattcactatttttgccctatataaaacattaaaataacatgctctgtacacatgctgtcaacaaaagccagctctaggaacctgagtgccagaatgcctgagggagctacagctgggcttagttggctgggattgagctcgctgtctgagggagctcgctctgtctctctcacactggcagtttacaccagccggcagccctgagcagcagtgggtgtaactttttataaataaggattcattgattcattcatattctcaatatttcttgaagacctaccccgagccaagcatggtgccaggcagtggggatgcagtggagagcaaacagccctgcccatgcaaagtgtcctgtacggtgagaagtgtgagctgcacccacaaagggaaagagcccagtgcagcttttgcaaaatgcagggaaggatgctgctagcctcagggtgacctagaactttaagctcatctttgttttcaggagcccagtgcctcccctccacccctaaagaatatctcaaagacgtggattttcatttcagtaagatttaggggtgcatgggcaggcagtgctggaggaactgggaggcaggtttggaggctgcagtgggaccactggcccctcctggctacagtttcaggccaggagcttgttggcacctggtgcaaactcccaaacctgaggggtccccacaaccccccagcccatcttaacctcctcttcccccaagctatctggtgttggaaagccagcatctagtgtggaaacaagctttctcaccaggtaggccatccgctgtcaggaccattaggtaaaaacagaagtgacaggttgtaggaagtcgttcgatctgtgaggctgcgagcacttcagtgcctgggatttacctaactgccatgaaacactgattatccagcattcagcatgtgtcagattctgtaactatttctcctgtgatgtatcagtcagcttttgctgcaaaacagcatcagaaatctcagtggtctacaactagattcccattcttgggtagtctacaagttggcttctaggttatgctccaggctgggggtctgatcacgtctgctccacaacatgtcccgtattctgggtccctggttgaagcagcagcttaccttgggccgtgttctttctcatggcagaagcacaggaggccaagccctaccttgcaagcacaaatacagcccctgctcactttctgttggccacaacacatggccatgcctgacctctgtggggtgaggcagtgcatggccaaggaacaagcacagtccacacagggggctgtcactccgtgacctcagtattacaaaatggttctcaaggagtcgcaaaatgtgtggcagatcatccatgatttgtttcccgtgtgctttacgaatatcctgaaatttttaaaagctgtttccattagaagggatctgttggggatttgaggtgagatgagaaagaccctgcattccagcccctcagttagcagtggtgaggccggagtactccacacgggacagttttaggaaagtgctggaatccaaagtttctccggagggctatgcaaggcgctttggaaaggcgaagcctgggcgcagggagcccagccatgtaggtagaagcagcagacggtgagggaggccatccccacctggccctgccagggccctgactcagtgaaggaagctgttgggatacaggtcattcagccgggcaggaaagatgggatgaagcccagcaagttcacagggatccgggaagttgtgtggctggaaacccaggcagggctgcaccacagggaccatttgctggagatgcagcacttgccacagccaccaccactgacagcatgacacccacaaaaagggagcctccagctgcacccctgctgctgcgagtacttcctcagctgtctgccatgagcttaaggttaagtaccaggagggaggatatgattgggcaaacctcaggcatgtgttcattctgtagcttccagaacatgcgaggagagagcatctggctcctttgtctcgaggaggagggggcaggactctgccagaactcactcgataaaagattttcccaaaaggaagggtgttcagatgacaaaagtccactacaccactttccttggctatctgatgcacccccatcttcccatgcgcgcacctcagaaatcaggctcccacctgacataacacaaccatgcctcacaaaaagacagtggtttatcccttccctaggagaaaagagaggcaatgccaagctgcttcatcaactgttaatacttcttccagcccgcaacccaggatatctgcaggtgtctctccctctggtttggtcatggctctctctgttctagaatgtatgggttaaagtcggctgccacaccatgccctcggcagtgtggtccaaggacccctgagggtcctcaaggtccttcctttcccaaccccacgtggttttcttcagtcaggataccatactgcaacagaccgaaggcggaagcagctatgaggatgcagcagccttctgttaagccaggctttaaggatctgcaaaaatgtaaaacgatgccactcctactgatgaaatatattgttttggaaaatataggtttaaaaatttttttaaggtaacatgtaatggatgtatagtcttcaaatggatgaataaatgtttttcagagttaaaaaaaacacacaaaacaacaaaaaaaaaaaaaaaaacaaaaaaaaaaaacaaacaaaaaaaacaaaaacaaaaaaaacacagctcgcggcgcgcggccgcccccgcccccccaagaaaagaatccaaaccccccacccctgggggcgggcgggcgccccccctgaaagacaccacaggggccacacgttccccccgaaaaaccccgcccggcacaagggggggcggggttctcaccccaaaaaaaaaaacgccaggcgggagataaagcacgcgtttgtcaaaaccacaccaaccagaaagatctagcaggagaatcaatgtaggtatcataaccagggggacaacacagcgaaccctaaaaaaacaaacccccccccgctctcgaacgagaagaccacaagcagaagcagcaacgaagacgaacaaaacaagtagaaaagtacaaacactagtagatacaacagtaagacgcagcataagaaaagacgagacagagcaggggcacagcgcggagaaggggagcagagaggagagaacggaaggcgggcacgaagagaggagtgaggcgacgatagaagagagcgtggagagagacagatgaagatgacgcgcagcacacgagagagaagagaaggggataaaaaatgatagagagacagagggacgaggagcagtgtgagggagagagggaaagaagagagaggggaaagtggagagagcagataggaggagggaggggaggggggtgagagacaggtaggaggtgtcaggagagtggcaga

SEQ ID NO: 451554 - DNA, 6267 bp, Homo sapiens
tgtgagctcactcccgcctccatgttcccggagtcgcctggaagcgtccgcccaaggtcgcgggccgcttggggagtcagcagcgcgccaggccccttcgggccccacacgcattaggtgccttcttgatgggtacggagtgaacgcgggcggcggcgggaccgaggcagcgcccagtttgtaaccgccgcgccgcccgtgcccgcgcgcgccacaccccagcgcgcttccggccgggccacgtgaccgcgcgtgcacgtgttccggcctctccgcttcgccgctccgaacctcctcctggtcgtcccggcattcgtccacgcggagccggcttgggcggggcccgggaggcggcggccggagaagccgcggagacgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtggtgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttaggtgtgaagatatgtgtctattggcagatgtccttgaaaactgcataaaacagtatgtgcctggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttttccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttcaaattatctttgtagataagaacagtgtttcttttttcttttcttttgttttttgttgtttgttttgttttgttttgagacagagtttcactcttgttgcccaggctggagtgcaatggcacaatcttgatctcagctcgccgcagcctccgcctcccggttcaagcgattcttctgcctcagcctcccgagtagctgggattacaggcatgcaccaccacgcctggctaatttcgtatttttaatagagacagggtttctccatgttggtcaggctggtctcaaactcctgacttgaggtgatctgcccgccttggcctcccaaagtgctgggattacaggcgggaaccactgcacccggcaggtacagtgtttctttaggtgctggtggtacaccagggaatcagggcagaagctggatcctgcaagagtaatgtttgagaacaaataaatactttcgaaaggaggtcgaaacaaaaaggagtgtaggtgttattactgcagagaagactgaatggagtccacttttcttattagtaacttactaaaaatgatctcaaatgggctccacacactttgccctggccatgaggcaaacttgttgggtttggagaaaaacacataaccctaaattcactatttttgccctatataaaacattaaaataacatgctctgtacacatgctgtcaacaaaagccagctctaggaacctgagtgccagaatgcctgagggagctacagctgggcttagttggctgggattgagctcgctgtctgagggagctcgctctgtctctctcacactggcagtttacaccagccggcagccctgagcagcagtgggtgtaactttttataaataaggattcattgattcattcatattctcaatatttcttgaagacctaccccgagccaagcatggtgccaggcagtggggatgcagtggagagcaaacagccctgcccatgcaaagtgtcctgtacggtgagaagtgtgagctgcacccacaaagggaaagagcccagtgcagcttttgcaaaatgcagggaaggatgctgctagcctcagggtgacctagaactttaagctcatctttgttttcaggagcccagtgcctcccctccacccctaaagaatatctcaaagacgtggattttcatttcagtaagatttaggggtgcatgggcaggcagtgctggaggaactgggaggcaggtttggaggctgcagtgggaccactggcccctcctggctacagtttcaggccaggagcttgttggcacctggtgcaaactcccaaacctgaggggtccccacaaccccccagcccatcttaacctcctcttcccccaagctatctggtgttggaaagccagcatctagtgtggaaacaagctttctcaccaggtaggccatccgctgtcaggaccattaggtaaaaacagaagtgacaggttgtaggaagtcgttcgatctgtgaggctgcgagcacttcagtgcctgggatttacctaactgccatgaaacactgattatccagcattcagcatgtgtcagattctgtaactatttctcctgtgatgtatcagtcagcttttgctgcaaaacagcatcagaaatctcagtggtctacaactagattcccattcttgggtagtctacaagttggcttctaggttatgctccaggctgggggtctgatcacgtctgctccacaacatgtcccgtattctgggtccctggttgaagcagcagcttaccttgggccgtgttctttctcatggcagaagcacaggaggccaagccctaccttgcaagcacaaatacagcccctgctcactttctgttggccacaacacatggccatgcctgacctctgtggggtgaggcagtgcatggccaaggaacaagcacagtccacacagggggctgtcactccgtgacctcagtattacaaaatggttctcaaggagtcgcaaaatgtgtggcagatcatccatgatttgtttcccgtgtgctttacgaatatcctgaaatttttaaaagctgtttccattagaagggatctgttggggatttgaggtgagatgagaaagaccctgcattccagcccctcagttagcagtggtgaggccggagtactccacacgggacagttttaggaaagtgctggaatccaaagtttctccggagggctatgcaaggcgctttggaaaggcgaagcctgggcgcagggagcccagccatgtaggtagaagcagcagacggtgagggaggccatccccacctggccctgccagggccctgactcagtgaaggaagctgttgggatacaggtcattcagccgggcaggaaagatgggatgaagcccagcaagttcacagggatccgggaagttgtgtggctggaaacccaggcagggctgcaccacagggaccatttgctggagatgcagcacttgccacagccaccaccactgacagcatgacacccacaaaaagggagcctccagctgcacccctgctgctgcgagtacttcctcagctgtctgccatgagcttaaggttaagtaccaggagggaggatatgattgggcaaacctcaggcatgtgttcattctgtagcttccagaacatgcgaggagagagcatctggctcctttgtctcgaggaggagggggcaggactctgccagaactcactcgataaaagattttcccaaaaggaagggtgttcagatgacaaaagtccactacaccactttccttggctatctgatgcacccccatcttcccatgcgcgcacctcagaaatcaggctcccacctgacataacacaaccatgcctcacaaaaagacagtggtttatcccttccctaggagaaaagagaggcaatgccaagctgcttcatcaactgttaatacttcttccagcccgcaacccaggatatctgcaggtgtctctccctctggtttggtcatggctctctctgttctagaatgtatgggttaaagtcggctgccacaccatgccctcggcagtgtggtccaaggacccctgagggtcctcaaggtccttcctttcccaaccccacgtggttttcttcagtcaggataccatactgcaacagaccgaaggcggaagcagctatgaggatgcagcagccttctgttaagccaggctttaaggatctgcaaaaatgtaaaacgatgccactcctactgatgaaatatattgttttggaaaatataggtttaaaaatttttttaaggtaacatgtaatggatgtatagtcttcaaatggatgaataaatgtttttcagagttattggctttaacttctaagatgctaaatgttgacgtagctcataaacaaaagcccgttgaggtcctcggtcatttcaagagtgtgagggggtcttgtgaccaaagcatttgagaactgctgtcctatattatcatgggggaaagagaggataaagaaaatagaagtttaatgaattaaaatctgtgctttaacctttagcctaacccctgaataggcttgagtggggggttgaacgatgaattgtggctgaataaaaacctagcatattggagaagttaaatatctgtaatgggtactttagtttaagattattagttatgagcttgagctctattgc

SEQ ID NO: 451555 - DNA, 3031 bp, Homo sapiens
tgtgagctcactcccgcctccatgttcccggagtcgcctggaagcgtccgcccaaggtcgcgggccgcttggggagtcagcagcgcgccaggccccttcgggccccacacgcattaggtgccttcttgatgggtacggagtgaacgcgggcggcggcgggaccgaggcagcgcccagtttgtaaccgccgcgccgcccgtgcccgcgcgcgccacaccccagcgcgcttccggccgggccacgtgaccgcgcgtgcacgtgttccggcctctccgcttcgccgctccgaacctcctcctggtcgtcccggcattcgtccacgcggagccggcttgggcggggcccgggaggcggcggccggagaagccgcggagacgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtggtgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttaggtgtgaagatatgtgtctattggcagatgtccttgaaaactgcataaaacagtatgtgcctggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttttccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagcttcaacaccacccttgccccaagtcttttaacctgggtgttagcattttaaagagacccccacagagttttggcccgtgactaaactaactccccacccccagcccaaaacttggggagactggaactattgatgtttggccaacccaagacttttttttgggggttaaaggagaaat

SEQ ID NO: 451556 - DNA, 4892 bp, Homo sapiens
tgtgagctcactcccgcctccatgttcccggagtcgcctggaagcgtccgcccaaggtcgcgggccgcttggggagtcagcagcgcgccaggccccttcgggccccacacgcattaggtgccttcttgatgggtacggagtgaacgcgggcggcggcgggaccgaggcagcgcccagtttgtaaccgccgcgccgcccgtgcccgcgcgcgccacaccccagcgcgcttccggccgggccacgtgaccgcgcgtgcacgtgttccggcctctccgcttcgccgctccgaacctcctcctggtcgtcccggcattcgtccacgcggagccggcttgggcggggcccgggaggcggcggccggagaagccgcggagacgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtggtgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttaggtgtgaagatatgtgtctattggcagatgtccttgaaaactgcataaaacagtatgtgcctggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttttccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttcaaattatctttgtagataagaacagtgtttcttttttcttttcttttgttttttgttgtttgttttgttttgttttgagacagagtttcactcttgttgcccaggctggagtgcaatggcacaatcttgatctcagctcgccgcagcctccgcctcccggttcaagcgattcttctgcctcagcctcccgagtagctgggattacaggcatgcaccaccacgcctggctaatttcgtatttttaatagagacagggtttctccatgttggtcaggctggtctcaaactcctgacttgaggtgatctgcccgccttggcctcccaaagtgctgggattacaggcgggaaccactgcacccggcaggtacagtgtttctttaggtgctggtggtacaccagggaatcagggcagaagctggatcctgcaagagtaatgtttgagaacaaataaatactttcgaaaggaggtcgaaacaaaaaggagtgtaggtgttattactgcagagaagactgaatggagtccacttttcttattagtaacttactaaaaatgatctcaaatgggctccacacactttgccctggccatgaggcaaacttgttgggtttggagaaaaacacataaccctaaattcactatttttgccctatataaaacattaaaataacatgctctgtacacatgctgtcaacaaaagccagctctaggaacctgagtgccagaatgcctgagggagctacagctgggcttagttggctgggattgagctcgctgtctgagggagctcgctctgtctctctcacactggcagtttacaccagccggcagccctgagcagcagtgggtgtaactttttataaataaggattcattgattcattcatattctcaatatttcttgaagacctaccccgagccaagcatggtgccaggcagtggggatgcagtggagagcaaacagccctgcccatgcaaagtgtcctgtacggtgagaagtgtgagctgcacccacaaagggaaagagcccagtgcagcttttgcaaaatgcagggaaggatgctgctagcctcagggtgacctagaactttaagctcatctttgttttcaggagcccagtgcctcccctccacccctaaagaatatctcaaagacgtggattttcatttcagtaagatttaggggtgcatgggcaggcagtgctggaggaactgggaggcaggtttggaggctgcagtgggaccactggcccctcctggctacagtttcaggccaggagcttgttggcacctggtgcaaactcccaaacctgaggggtccccacaaccccccagcccatcttaacctcctcttcccccaagctatctggtgttggaaagccagcatctagtgtggaaacaagctttctcaccaggtaggccatccgctgtcaggaccattaggtaaaaacagaagtgacaggttgtaggaagtcgttcgatctgtgaggctgcgagcacttcagtgcctgggatttacctaactgccatgaaacactgattatccagcattcagcatgtgtcagattctgtaactatttctcctgtgatgtatcagtcagcttttgctgcaaaacaagcatctggctcctttgtctcgaggaggagggggcaggactctgccagaactcactcgataaaagattttcccaaaaggaagggtgttcagatgacaaaagtccactacaccactttccttggctatctgatgcacccccatcttcccatgcgcgcacctcagaaatcaggctcccacctgacataacacaaccatgcctcacaaaaagacagtggtttatcccttccctaggagaaaagagaggcaatgccaagctgcttcatcaactgttaatacttcttccagcccgcaacccaggatatctgcaggtgtctctccctctggtttggtcatggctctctctgttctagaatgtatgggttaaagtcggctgccacaccatgccctcggcagtgtggtccaaggacccctgagggtcctcaaggtccttcctttcccaaccccacgtggttttcttcagtcaggataccatactgcaacagaccgaaggcggaagcagctatgaggatgcagcagccttctgttaagccaggctttaaggatctgcaaaaatgtaaaacgatgccactcctactgatgaaatatattgttttggaaaatataggtttaaaaatttttttaaggtaacatgtaatggatgtatagtcttcaaatggatgaataaatgtttttcagagtta

SEQ ID NO: 451557 - DNA, 3073 bp, Homo sapiens
tgtgagctcactcccgcctccatgttcccggagtcgcctggaagcgtccgcccaaggtcgcgggccgcttggggagtcagcagcgcgccaggccccttcgggccccacacgcattaggtgccttcttgatgggtacggagtgaacgcgggcggcggcgggaccgaggcagcgcccagtttgtaaccgccgcgccgcccgtgcccgcgcgcgccacaccccagcgcgcttccggccgggccacgtgaccgcgcgtgcacgtgttccggcctctccgcttcgccgctccgaacctcctcctggtcgtcccggcattcgtccacgcggagccggcttgggcggggcccgggaggcggcggccggagaagccgcggagacgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtggtgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttaggtgtgaagatatgtgtctattggcagatgtccttgaaaactgcataaaacagtatgtgcctggtgtggatcttaccaaagtactaggcatgaatgtagggactgcaaatcccatgggtcttaatatttaggtgttagtaaccaaggtctctggtagtacccgttagtagaggaagaggccactgcccttgggaacttgtgacaggctctagtgtggtaccaggccataaagtgacactgttatttagcaacttgaatttttccacacaggtagtaactgtgtggaaataagcaacaagtggtttgtccatttctaagaatcttaaactattagttggctgtagtgtgaagcattacttgtcattggaaagatggagagagtggccttaaccggaagtggtcagtagaagcaggtgtcattttaagggccaaactttaatctgtcagcaatagggaaacaactgttcaaattatctttgtagataagaacagtgtttcttttttcttttcttttgttttttgttgtttgttttgttttgttttgagacagagtttcactcttgttgcccaggctggagtgcaatggcacaatcttgatctcagctcgccgcagcctccgcctcccggttcaagcgattcttctgcctcagcctcccgagtagctgggattacaggcatgcaccaccacgcctggctaatttcgtatttttaatagagacagggtttctccatgttggtcaggctggtctcaaactcctgacttgaggtgatctgcccgccttggcctcccaaagtgctgggattacaggcgggaaccactgcacccggcaggtacagtgtttctttaggtgctggtggtacaccagggaatcagggcagaagctggatcctgcaagagtaatgtttgagaacaaataaatactttcgaaaggaggtcgaaaca

SEQ ID NO: 451558 - DNA, 1721 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451559 - DNA, 1673 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcggggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451560 - DNA, 1620 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451561 - DNA, 1609 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggggttctgcactccccaagccacctttccactccctgcatcacacgcgagacacctccagaccca

SEQ ID NO: 451562 - DNA, 1380 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggtgagtgggagtggggagtttgtgggattgaccctgaaatttctccacccctctccaccaggcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaagggtaagaggtcaggaggaagaatgcccgcccttgcccagcgtgtcctcaccctcccagagctgtcaacagtgaccacttttgccatccttattgcaattcaattggaagatggggagactgagttacagagaggatatggggctggacagagtctgagtcttagttttcaaatacctcatggtcagggggagagtactaatcccacactcgctcccttcatccagtatttcttttcgaggtcagttaaacttgc

SEQ ID NO: 451563 - DNA, 2538 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451564 - DNA, 2043 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacaggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451565 - DNA, 2713 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagggaggtgtgcttcgcgtgtgatgccagggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451566 - DNA, 632 bp, Homo sapiens
  misc_feature (22)..(22): n is a, c, g, or t
gtgactccgaggattaaaagtncactcttctatatctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451567 - DNA, 879 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggtgagttgagagagttgagttggaggtgtgccccagacatggtgtgtgccatgatgcagggagtggtttccttattggtaaaacagggatagcatttctacatctagaattgttggaattaaatgagaaccatgaaaaaagagaaccaaaactcttaccacagtgtctgagtatatgtctatgataaactcaataaatggtattggcaatagtgatggtgatggtga

SEQ ID NO: 451568 - DNA, 2011 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagggaggtgtgcttcgcgtgtgatgccagggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaacttctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451569 - DNA, 1524 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagggaggtgtgcttcgcgtgtgatgccagggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccagctcagatctaactggactctcgctcctgctggctggacatggaggatttggaggaagtgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451570 - DNA, 2485 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451571 - DNA, 1811 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggtgagtgggagtggggagtttgtgggattgaccctgaaatttctccacccctctccaccaggcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451572 - DNA, 1851 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgtatatctggaagtcgatcctgctcctatttctttctctttttttagacagaatcttgctctgtcacccaagatcgcgccactgcattccagcctggtggcagagtgagactccatctcaaa

SEQ ID NO: 451573 - DNA, 2523 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagggaggtgtgcttcgcgtgtgatgccagggagtggaaagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451574 - DNA, 2814 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagggaggtgtgcttcgcgtgtgatgccagggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451575 - DNA, 1606 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451576 - DNA, 2490 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggagtcacccacttgcaatctgttccctgcatccaaaagcccagcatcttctcctcttacccgatcgactcccccagtccgggggagagccgggcccagtgggagagcagcagccagtgaggagaccagagcagccaagttgcggggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaaggttcctgtttcccagcgactaaatcttcctgtcatgggtgccactcgcagcaatctgcagccccccaggaaagtggcagtcccaggacctaccaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtattttta

SEQ ID NO: 451577 - DNA, 751 bp, Homo sapiens
cccctcggagctgattcccgggactaggttgcgggagaaagcctgttgcgtggaagataaggcggcgcgggaagtggacacagggtgggctggagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagaggagtcaccacttgcagtctgtcctgattcaaaagccagatcttctctcttaacgatgatcccagtcgggaagcggccatgaaaacggaaggacaacgcaa

SEQ ID NO: 451578 - DNA, 2141 bp, Homo sapiens
ggcacgagggttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataaaaaaaaaaaaaaaaaaaaaaaaaattgcgggagaaagcctgttgcgtggaagataaggcggcgcgggaagtggacacagggtgggctggagggaggtgtgcttcgcgtgtgatgccagggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccagctcagatctaactggactctcgctcctgctggctggacatggaggatttggaggaagatgtaaggtttattgtggatgagaccttggactttggggggctgtcaccatctgacagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaacttctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgtatatctggaagtcgatcctgctcctatttctttctctttttttagacagaatcttgctctgtcacccaagatcgcgccactgcattccagcctggtggcagagtgagactccatctcaaa

SEQ ID NO: 451579 - DNA, 213 bp, Homo sapiens
tatcttaatttagagttacattctttgttaaagtgaattataatgtacattaggacagaatatacaacatattttaaagcggcttattttaaaaaaaaggctttcagtaagtatgtgttagaatgctaaaataatcatatacagaaacatttacattttaataagtgggaatacagcagccttgtcttactatacttttgtaataaataatgg

SEQ ID NO: 451580 - DNA, 336 bp, Homo sapiens
ctagacgatccctaaggctggtctgggtccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacaggtttgatacaaatgccttgcttatcatttttaacactttctgattgtatatatacaacatacttgtttcaaagcactggatataataaaaaagtaaagaaatgtaaaaaatcactaattgt

SEQ ID NO: 451581 - DNA, 3574 bp, Homo sapiens
gtagagacagggtcttgctttgttgcccaggctggtctcgaactcctggcttcaaggaatcctccagcttcaacttccaaaagcattgggattaccggcatgagccatcactccagccccttagggcttatataccataggggaggggtggttcagaagggatgtgtaggacaattgaagtataataacatcaagttgtttgaattaaggacagaacatactgggtagatacctgctcttacacaaggaacaatagataaagtagaaatcttagaggccttcccagaactggggtcaatcagaagtcaacacggaggattagcttccaagatggagctgctttcgcctccacatccagcaattccactcttagattccaattccactcaacagaaatggaaacataggtccataaaaaaactgtacatgactgtgtacagcagccttattcacaatagccaaaatgtggaaacaactgaaatgtccatcaactgatgaatggataaacaaaatgcaacagaatatgctccagcaatctaaaggaacgaagtactgtacagatacatgctacaacatagatgaaccttgaaagcattacgctaaatgaaagaagccagacacaaaaggccacatattgtatggctccatttatatgaaatatccagaataggcaaacccatagagacaggaaattgattattgtttgctagggctggggtttggagggtagagttaggaagagtgacagctagagggtatgggtttcttttacatgtgatgaaaatgttctcaaattgtggtgattgttgaacatatctggaaatatactaaaaatcgctgaatggtatactttaaatggttgacttgtttggtatgtgagttatatcccaataaagctgttatataaaaaaaaatcatgcgagcaattatctcaacaatcaagagactgtgttaaagattctttgcttggccaaacttcagttaggcttctgaatcttctcccaggtccttgtgtgcacttccttgtaaatgcagtgttaggaagtaacactgccacggcagtttagcaagaatcccccaccctccatatgtgatcaaaattctttactcctacccttagtatctgaccccctggcctgccttcactgggactcctgttaggttggttcagccagaatttcccccagaattgatgtttcctcttagcagttttccgaacacctgctccttgctccttggctataaatctccacttattcctggtgtatttggaatagttacgactgagttgccttcacccctttaacttccgtctttttttttttttcacaatggaggacacaaaacgttgttatttcaagtctttgtggccaacagattggtggtttatgggccagcatccctttttatgcgtaaaatatttaaaacgcagcctgcaatggttggtaaagtggtgaaacgtttagtgtgtgaggtcggatcctggtctggccgctggccctggcgatcctctgaggcggcctgagtttggggcgcctcgtgtcaccgcgcgcccctcctccgggcctgagtcacggtgccgccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagaggtgcgcgcccagctgaagaagggcccagccgggggcctagtcggggccggtcgtggggacgccggccggagatctgagggacgggaggcggcgtgggggccgggcacggaggcaggggccggacgcgtgtccagggcctgggctgggggctgtggcggaaacctgaggtcggggtgagaggccgggggcctggtctgggccggagcctgccggggacaggaactggatgacgggccaggccagattccaccgcggagccgaggcatgccgagctatccggcagtgcaggtcccggcggccgcgggcagctcacccggaaggccgcgcggggtccgggcgtggatcccggcacgcgagcccgggcgttcgcaggggaggattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacaggtttgatacaaatgccttgcttatcatttttaacactttctgattgtatatatacaacatacttgtttcaaagcactggatataataaaaaagtaaagaaatgtaaaaaatcactaattgt

SEQ ID NO: 451582 - DNA, 3519 bp, Homo sapiens
  misc_feature (3464)..(3464): n is a, c, g, or t
gtagagacagggtcttgctttgttgcccaggctggtctcgaactcctggcttcaaggaatcctccagcttcaacttccaaaagcattgggattaccggcatgagccatcactccagccccttagggcttatataccataggggaggggtggttcagaagggatgtgtaggacaattgaagtataataacatcaagttgtttgaattaaggacagaacatactgggtagatacctgctcttacacaaggaacaatagataaagtagaaatcttagaggccttcccagaactggggtcaatcagaagtcaacacggaggattagcttccaagatggagctgctttcgcctccacatccagcaattccactcttagattccaattccactcaacagaaatggaaacataggtccataaaaaaactgtacatgactgtgtacagcagccttattcacaatagccaaaatgtggaaacaactgaaatgtccatcaactgatgaatggataaacaaaatgcaacagaatatgctccagcaatctaaaggaacgaagtactgtacagatacatgctacaacatagatgaaccttgaaagcattacgctaaatgaaagaagccagacacaaaaggccacatattgtatggctccatttatatgaaatatccagaataggcaaacccatagagacaggaaattgattattgtttgctagggctggggtttggagggtagagttaggaagagtgacagctagagggtatgggtttcttttacatgtgatgaaaatgttctcaaattgtggtgattgttgaacatatctggaaatatactaaaaatcgctgaatggtatactttaaatggttgacttgtttggtatgtgagttatatcccaataaagctgttatataaaaaaaaatcatgcgagcaattatctcaacaatcaagagactgtgttaaagattctttgcttggccaaacttcagttaggcttctgaatcttctcccaggtccttgtgtgcacttccttgtaaatgcagtgttaggaagtaacactgccacggcagtttagcaagaatcccccaccctccatatgtgatcaaaattctttactcctacccttagtatctgaccccctggcctgccttcactgggactcctgttaggttggttcagccagaatttcccccagaattgatgtttcctcttagcagttttccgaacacctgctccttgctccttggctataaatctccacttattcctggtgtatttggaatagttacgactgagttgccttcacccctttaacttccgtctttttttttttttcacaatggaggacacaaaacgttgttatttcaagtctttgtggccaacagattggtggtttatgggccagcatccctttttatgcgtaaaatatttaaaacgcagcctgcaatggttggtaaagtggtgaaacgtttagtgtgtgaggtcggatcctggtctggccgctggccctggcgatcctctgaggcggcctgagtttggggcgcctcgtgtcaccgcgcgcccctcctccgggcctgagtcacggtgccgccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagaggtgcgcgcccagctgaagaagggcccagccgggggcctagtcggggccggtcgtggggacgccggccggagatctgagggacgggaggcggcgtgggggccgggcacggaggcaggggccggacgcgtgtccagggcctgggctgggggctgtggcggaaacctgaggtcggggtgagaggccgggggcctggtctgggccggagcctgccggggacaggaactggatgacgggccaggccagattccaccgcggagccgaggcatgccgagctatccggcagtgcaggtcccggcggccgcgggcagctcacccggaaggccgcgcggggtccgggcgtggatcccggcacgcgagcccgggcgttcgcaggggaggattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagttatttggcanaaaactttgggaaaaaaactggttcttggaatgggtggcaaccgggaatttttaa

SEQ ID NO: 451583 - DNA, 2575 bp, Homo sapiens
gtagagacagggtcttgctttgttgcccaggctggtctcgaactcctggcttcaaggaatcctccagcttcaacttccaaaagcattgggattaccggcatgagccatcactccagccccttagggcttatataccataggggaggggtggttcagaagggatgtgtaggacaattgaagtataataacatcaagttgtttgaattaaggacagaacatactgggtagatacctgctcttacacaaggaacaatagataaagtagaaatcttagaggccttcccagaactggggtcaatcagaagtcaacacggaggattagcttccaagatggagctgctttcgcctccacatccagcaattccactcttagattccaattccactcaacagaaatggaaacataggtccataaaaaaactgtacatgactgtgtacagcagccttattcacaatagccaaaatgtggaaacaactgaaatgtccatcaactgatgaatggataaacaaaatgcaacagaatatgctccagcaatctaaaggaacgaagtactgtacagatacatgctacaacatagatgaaccttgaaagcattacgctaaatgaaagaagccagacacaaaaggccacatattgtatggctccatttatatgaaatatccagaataggcaaacccatagagacaggaaattgattattgtttgctagggctggggtttggagggtagagttaggaagagtgacagctagagggtatgggtttcttttacatgtgatgaaaatgttctcaaattgtggtgattgttgaacatatctggaaatatactaaaaatcgctgaatggtatactttaaatggttgacttgtttggtatgtgagttatatcccaataaagctgttatataaaaaaaaatcatgcgagcaattatctcaacaatcaagagactgtgttaaagattctttgcttggccaaacttcagttaggcttctgaatcttctcccaggtccttgtgtgcacttccttgtaaatgcagtgttaggaagtaacactgccacggcagtttagcaagaatcccccaccctccatatgtgatcaaaattctttactcctacccttagtatctgaccccctggcctgccttcactgggactcctgttaggttggttcagccagaatttcccccagaattgatgtttcctcttagcagttttccgaacacctgctccttgctccttggctataaatctccacttattcctggtgtatttggaatagttacgactgagttgccttcacccctttaacttccgtctttttttttttttcacaatggaggacacaaaacgttgttatttcaagtctttgtggccaacagattggtggtttatgggccagcatccctttttatgcgtaaaatatttaaaacgcagcctgcaatggttggtaaagtggtgaaacgtttagtgtgtgaggtcggatcctggtctggccgctggccctggcgatcctctgaggcggcctgagtttggggcgcctcgtgtcaccgcgcgcccctcctccgggcctgagtcacggtgccgccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagaggtgcgcgcccagctgaagaagggcccagccgggggcctagtcggggccggtcgtggggacgccggccggagatctgagggacgggaggcggcgtgggggccgggcacggaggcaggggccggacgcgtgtccagggcctgggctgggggctgtggcggaaacctgaggtcggggtgagaggccgggggcctggtctgggccggagcctgccggggacaggaactggatgacgggccaggccagattccaccgcggagccgaggcatgccgagctatccggcagtgcaggtcccggcggccgcgggcagctcacccggaaggccgcgcggggtccgggcgtggatcccggcacgcgagcccgggcgttcgcaggggagggtgagtacgctgcccggcgggcaccccctttctaatccttccccttaatcgggtccaggcactcggcgccggcgccgcagagttggtcgccgggcggcaccgagcaggccggcgaccacccactcgcattgccgcgcctttttcctgccgactcctttagacacaggactagctccatgccctggaaggctgggaggggggccgccggaaaggcctgattctgaggaaagccaaggtcctgcctcccaaacacttgctccccgcgcagtggaccttgtgttggaaagctttgcagtcgaaatcgcggtgcggcagcggagcactcattctcaccagcatccca

SEQ ID NO: 451584 - DNA, 1206 bp, Homo sapiens
aggaaataataaatagagcagcaaattatgtagacttgctcccctagaactctcattccagtggggaagttacactaggtaaaacatgcagattttatcatagcaggttctgtacacatgttcttaaagtagcatagtttggcacacttcttctcttcctgtattttgatatcttcccctttttgttagggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacaggtttgatacaaatgccttgcttatcatttttaacactttctgattgtatatatacaacatacttgtttcaaagcactggatataataaaaaagtaaagaaatgtaaaaaatcactaattgt

SEQ ID NO: 451585 - DNA, 3196 bp, Homo sapiens
gtagagacagggtcttgctttgttgcccaggctggtctcgaactcctggcttcaaggaatcctccagcttcaacttccaaaagcattgggattaccggcatgagccatcactccagccccttagggcttatataccataggggaggggtggttcagaagggatgtgtaggacaattgaagtataataacatcaagttgtttgaattaaggacagaacatactgggtagatacctgctcttacacaaggaacaatagataaagtagaaatcttagaggccttcccagaactggggtcaatcagaagtcaacacggaggattagcttccaagatggagctgctttcgcctccacatccagcaattccactcttagattccaattccactcaacagaaatggaaacataggtccataaaaaaactgtacatgactgtgtacagcagccttattcacaatagccaaaatgtggaaacaactgaaatgtccatcaactgatgaatggataaacaaaatgcaacagaatatgctccagcaatctaaaggaacgaagtactgtacagatacatgctacaacatagatgaaccttgaaagcattacgctaaatgaaagaagccagacacaaaaggccacatattgtatggctccatttatatgaaatatccagaataggcaaacccatagagacaggaaattgattattgtttgctagggctggggtttggagggtagagttaggaagagtgacagctagagggtatgggtttcttttacatgtgatgaaaatgttctcaaattgtggtgattgttgaacatatctggaaatatactaaaaatcgctgaatggtatactttaaatggttgacttgtttggtatgtgagttatatcccaataaagctgttatataaaaaaaaatcatgcgagcaattatctcaacaatcaagagactgtgttaaagattctttgcttggccaaacttcagttaggcttctgaatcttctcccaggtccttgtgtgcacttccttgtaaatgcagtgttaggaagtaacactgccacggcagtttagcaagaatcccccaccctccatatgtgatcaaaattctttactcctacccttagtatctgaccccctggcctgccttcactgggactcctgttaggttggttcagccagaatttcccccagaattgatgtttcctcttagcagttttccgaacacctgctccttgctccttggctataaatctccacttattcctggtgtatttggaatagttacgactgagttgccttcacccctttaacttccgtctttttttttttttcacaatggaggacacaaaacgttgttatttcaagtctttgtggccaacagattggtggtttatgggccagcatccctttttatgcgtaaaatatttaaaacgcagcctgcaatggttggtaaagtggtgaaacgtttagtgtgtgaggtcggatcctggtctggccgctggccctggcgatcctctgaggcggcctgagtttggggcgcctcgtgtcaccgcgcgcccctcctccgggcctgagtcacggtgccgccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacaggtttgatacaaatgccttgcttatcatttttaacactttctgattgtatatatacaacatacttgtttcaaagcactggatataataaaaaagtaaagaaatgtaaaaaatcactaattgt

SEQ ID NO: 451586 - DNA, 3652 bp, Homo sapiens
gtagagacagggtcttgctttgttgcccaggctggtctcgaactcctggcttcaaggaatcctccagcttcaacttccaaaagcattgggattaccggcatgagccatcactccagccccttagggcttatataccataggggaggggtggttcagaagggatgtgtaggacaattgaagtataataacatcaagttgtttgaattaaggacagaacatactgggtagatacctgctcttacacaaggaacaatagataaagtagaaatcttagaggccttcccagaactggggtcaatcagaagtcaacacggaggattagcttccaagatggagctgctttcgcctccacatccagcaattccactcttagattccaattccactcaacagaaatggaaacataggtccataaaaaaactgtacatgactgtgtacagcagccttattcacaatagccaaaatgtggaaacaactgaaatgtccatcaactgatgaatggataaacaaaatgcaacagaatatgctccagcaatctaaaggaacgaagtactgtacagatacatgctacaacatagatgaaccttgaaagcattacgctaaatgaaagaagccagacacaaaaggccacatattgtatggctccatttatatgaaatatccagaataggcaaacccatagagacaggaaattgattattgtttgctagggctggggtttggagggtagagttaggaagagtgacagctagagggtatgggtttcttttacatgtgatgaaaatgttctcaaattgtggtgattgttgaacatatctggaaatatactaaaaatcgctgaatggtatactttaaatggttgacttgtttggtatgtgagttatatcccaataaagctgttatataaaaaaaaatcatgcgagcaattatctcaacaatcaagagactgtgttaaagattctttgcttggccaaacttcagttaggcttctgaatcttctcccaggtccttgtgtgcacttccttgtaaatgcagtgttaggaagtaacactgccacggcagtttagcaagaatcccccaccctccatatgtgatcaaaattctttactcctacccttagtatctgaccccctggcctgccttcactgggactcctgttaggttggttcagccagaatttcccccagaattgatgtttcctcttagcagttttccgaacacctgctccttgctccttggctataaatctccacttattcctggtgtatttggaatagttacgactgagttgccttcacccctttaacttccgtctttttttttttttcacaatggaggacacaaaacgttgttatttcaagtctttgtggccaacagattggtggtttatgggccagcatccctttttatgcgtaaaatatttaaaacgcagcctgcaatggttggtaaagtggtgaaacgtttagtgtgtgaggtcggatcctggtctggccgctggccctggcgatcctctgaggcggcctgagtttggggcgcctcgtgtcaccgcgcgcccctcctccgggcctgagtcacggtgccgccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagaggtgcgcgcccagctgaagaagggcccagccgggggcctagtcggggccggtcgtggggacgccggccggagatctgagggacgggaggcggcgtgggggccgggcacggaggcaggggccggacgcgtgtccagggcctgggctgggggctgtggcggaaacctgaggtcggggtgagaggccgggggcctggtctgggccggagcctgccggggacaggaactggatgacgggccaggccagattccaccgcggagccgaggcatgccgagctatccggcagtgcaggtcccggcggccgcgggcagctcacccggaaggccgcgcggggtccgggcgtggatcccggcacgcgagcccgggcgttcgcaggggaggattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgatgtggagcttcccccttgggcttccagtcccgaggactttctccagaaggcc

SEQ ID NO: 451587 - DNA, 2625 bp, Homo sapiens
gtagagacagggtcttgctttgttgcccaggctggtctcgaactcctggcttcaaggaatcctccagcttcaacttccaaaagcattgggattaccggcatgagccatcactccagccccttagggcttatataccataggggaggggtggttcagaagggatgtgtaggacaattgaagtataataacatcaagttgtttgaattaaggacagaacatactgggtagatacctgctcttacacaaggaacaatagataaagtagaaatcttagaggccttcccagaactggggtcaatcagaagtcaacacggaggattagcttccaagatggagctgctttcgcctccacatccagcaattccactcttagattccaattccactcaacagaaatggaaacataggtccataaaaaaactgtacatgactgtgtacagcagccttattcacaatagccaaaatgtggaaacaactgaaatgtccatcaactgatgaatggataaacaaaatgcaacagaatatgctccagcaatctaaaggaacgaagtactgtacagatacatgctacaacatagatgaaccttgaaagcattacgctaaatgaaagaagccagacacaaaaggccacatattgtatggctccatttatatgaaatatccagaataggcaaacccatagagacaggaaattgattattgtttgctagggctggggtttggagggtagagttaggaagagtgacagctagagggtatgggtttcttttacatgtgatgaaaatgttctcaaattgtggtgattgttgaacatatctggaaatatactaaaaatcgctgaatggtatactttaaatggttgacttgtttggtatgtgagttatatcccaataaagctgttatataaaaaaaaatcatgcgagcaattatctcaacaatcaagagactgtgttaaagattctttgcttggccaaacttcagttaggcttctgaatcttctcccaggtccttgtgtgcacttccttgtaaatgcagtgttaggaagtaacactgccacggcagtttagcaagaatcccccaccctccatatgtgatcaaaattctttactcctacccttagtatctgaccccctggcctgccttcactgggactcctgttaggttggttcagccagaatttcccccagaattgatgtttcctcttagcagttttccgaacacctgctccttgctccttggctataaatctccacttattcctggtgtatttggaatagttacgactgagttgccttcacccctttaacttccgtctttttttttttttcacaatggaggacacaaaacgttgttatttcaagtctttgtggccaacagattggtggtttatgggccagcatccctttttatgcgtaaaatatttaaaacgcagcctgcaatggttggtaaagtggtgaaacgtttagtgtgtgaggtcggatcctggtctggccgctggccctggcgatcctctgaggcggcctgagtttggggcgcctcgtgtcaccgcgcgcccctcctccgggcctgagtcacggtgccgccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagaggtgcgcgcccagctgaagaagggcccagccgggggcctagtcggggccggtcgtggggacgccggccggagatctgagggacgggaggcggcgtgggggccgggcacggaggcaggggccggacgcgtgtccagggcctgggctgggggctgtggcggaaacctgaggtcggggtgagaggccgggggcctggtctgggccggagcctgccggggacaggaactggatgacgggccaggccagattccaccgcggagccgaggcatgccgagctatccggcagtgcaggtcccggcggccgcgggcagctcacccggaaggccgcgcggggtccgggcgtggatcccggcacgcgagcccgggcgttcgcaggggaggattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaagggtaagtaaagcttttcatgtatttccagcaatttatatagtcattttgaacaataaaattttgtgact

SEQ ID NO: 451588 - DNA, 302 bp, Homo sapiens
ttctggaagggcccatggcatgtgggcccggctcactgctctcctctacccccaggtgtgcatcccctttgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggccccccaataaaaggcagctgcctctgctccctctgaaaaaaaaaatattccatataaaagcagccgcaattcgagcctattt

SEQ ID NO: 451589 - DNA, 576 bp, Homo sapiens
tgctccagagaacgctgaaaagttgccaggacccgagacaagctgcccaggatgggcccttctaggtcgggggtggagggtggttgtgtccaggctggtggcggggggggcgggggaaattcccttccaccacccccaagctgggaggttggggtggcagggaggtgagaatcttcctcgggccccagggaaagggttcaagtttctggcagaagaaaccactcaaaccagttaactcttgcccacccactcggggtgccagggaacagcagtgcccagcagtttgctcaatcttgttaaccctgagccagcccagccacagcccgactgcagggctattctccctaatgcagagaggccgtgtttttcagggtctcctctctagcccctgggcctctttgcagagaggggcttgaaggagaatagtggggtcgcccgcccctagccacttcctctccagcagaggggccggcccctccattcagtgtgacggtgggccaagtgtcggcccctccccagcctgatcctctccatctgcgatgggacagagcaccccatctcccaagtcactcttga

SEQ ID NO: 451590 - DNA, 747 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaaaaaaaaaaaaaaaaaaccccgggggcctctatttggggggggggggaaaaaggggaaaaaaaggggccaggggaaaaggggtccgaccccattttttgggaaaaggggggaaaagcggggggccacaaaagggggggggaaaataaaaacggggtcctgtac

SEQ ID NO: 451591 - DNA, 878 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaggggggggggaaaaagttccccctcgggggcccaggtttaggcgcgtcccccggttttttttgtccgaaggggggccccctaatgggggcgcccgtatatataggcaaggggcggggccggcgtttacccgcgtccggcgcgggcaaacacgggtcgctgcgaacttttggggagagaccctttcctcgctgcgcgcgcccatgtgggcacccttccgacgggattgacgccttgggaaattaccttcgggttatggtgttaccccgcatttcgcgtgaaagtgtcgggtggtgact

SEQ ID NO: 451592 - DNA, 604 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggccccccaataaaaggcagctgcctctgctccctctgaaaaaaaaaatattccatataaaagcagccgcaattcgagcctattt

SEQ ID NO: 451593 - DNA, 758 bp, Homo sapiens
  misc_feature (23)..(24): n is a, c, g, or t
  misc_feature (28)..(28): n is a, c, g, or t
  misc_feature (31)..(31): n is a, c, g, or t
  misc_feature (610)..(610): n is a, c, g, or t
  misc_feature (612)..(612): n is a, c, g, or t
  misc_feature (615)..(616): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaacaaaaaaaaaaaaaaaaaaacaaaaaacaaaaaaaacacaananaannaaaaaaaaaaaaaaaaaaaaagaggggggggcggcacccaccatatatctacccccgggggggcgcccacaaatgacacgccgcccccaccttgtttgtaaaaagaggggggcgccccccaaagggggaggataaaaaaaac

SEQ ID NO: 451594 - DNA, 892 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaacaaaaaaaaaaaagggggggggggcaaaaagaatccccgggggggcccaatttccgttcccctttttgttgtacaggtgcgcctagagggaagggaataaaaacgcaaggggcggggcgcgcttaaacacggtcggcggggaccccgccgctcggattccgggaaggacctacgcgggccggcgcctgtcgcccctccacggattagcgccgggaatacacctcgcgttcggttcccccgctacggcgggaatcgtcccttgtgaatgcggccggcaacacagaacccacaaaaagccgacagaggccgc

SEQ ID NO: 451595 - DNA, 732 bp, Homo sapiens
  misc_feature (23)..(24): n is a, c, g, or t
  misc_feature (28)..(28): n is a, c, g, or t
  misc_feature (31)..(31): n is a, c, g, or t
  misc_feature (580)..(580): n is a, c, g, or t
  misc_feature (588)..(589): n is a, c, g, or t
  misc_feature (593)..(593): n is a, c, g, or t
  misc_feature (595)..(595): n is a, c, g, or t
  misc_feature (606)..(606): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaatnccggggcnnctangncgggggggggnaaaaagggggaggactgggcctggggtcaaagggggtctggacccagtttttttggccaaaggggggaaaagggcgggccccaaaagggggggcgaaaatcgaaaaaccagggaaccggttaggag

SEQ ID NO: 451596 - DNA, 1179 bp, Homo sapiens
  misc_feature (23)..(24): n is a, c, g, or t
  misc_feature (28)..(28): n is a, c, g, or t
  misc_feature (31)..(31): n is a, c, g, or t
  misc_feature (601)..(601): n is a, c, g, or t
  misc_feature (604)..(604): n is a, c, g, or t
  misc_feature (607)..(608): n is a, c, g, or t
  misc_feature (611)..(611): n is a, c, g, or t
  misc_feature (613)..(613): n is a, c, g, or t
  misc_feature (615)..(616): n is a, c, g, or t
  misc_feature (619)..(619): n is a, c, g, or t
  misc_feature (622)..(622): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcagcttcgtgctgaacctgggcaaagacagcaacaacctgtgcctgcacttcaaccctcgcttcaacgcccacggcgacgccaacaccatcgtgtgcacagcaagganggnggnnccngngnnacnagnagctgcctctgctccctctgaaaaaaaaaaaaaaaaaaaaaacctcgaagggcacactctagtgccgcgggcgccggaaaaacagagacggtacggaaaagggcccagtggccaataccgtgtcaccggaacccagtttcctggcccacaggggcgaaaaccgcgccgcggcccccccctaatcgcgggacgccgggaactcgaactctccgaaataagcccgggtgtaacccgcgtggccttacaaggaatccgcggcaaaaaaccccccccccacacacccacaccgcgagcccacaccgacccaccacccaccccgcaccacacgcgcaccggaaaatccaccacaagacggcgggacgagcaggccgagcgaataggcggcgcggtccacccgccggaccaaccccggccgactcccgaccacccactcgcccgccgcaaagacgcggtgaccgcacacgcgcttgtgccgcgtcgcggccccagcgctgcgtgaggagcctacctatgcactcgcccggcccccacatccgcaccccaactcacctacccaa

SEQ ID NO: 451597 - DNA, 2001 bp, Homo sapiens
  misc_feature (1800)..(1800): n is a, c, g, or t
caaagtgctggggttacaggcatgagccaccgtgcccgggagtattattattattatttgttaattcgccccataattactaagcatctttttctggtgtgccccacttgtgctgggcaccgggaatacagagatgtacaagacaggacgggaggtcaccatctggagggagtcactgaccttgaccaaacgggctaggatgctaatgacttcaagaatcaagcgagccctcctgtgcagcccccattgtacagatgagcaaacaggggaagaggggcaggagcaggtggcatggccagagctagaatccaggtttcttgtctctgttagtgagttcttccagcaaggtgcgttcatgggatactgagtgacagattagtcagtcagtggggctggagctggccgaggtggcctcatgcccacccgttaccccagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaaaaaaaaaaaaaaaaaacaaacaaaaaagaggggcgcgcgcgcgcgccaaaaaagatatctcccccgagagagggcgcccaaaagtgtatatcaggcatacaccccgggtattactcgctgagtaacacccaagagggggggccccccacaatagatgaggggcgagcgcgcactgaaataatatactaacggtgcgaggagacaagcagggcgcgcccgcaccgtctgtttacaacaaccagcgcgcgcggtggacaagcggggggcaaaacaaacggctggcgaacacacccagggggaggaacaaccctctgtgtgagcaaaggaggacgcacactcactactacccactgctcgggggggaggcggagcccaccaccacatatatgtgggggggccaacacaacaatacctcgtacctcaaacgaggaactatatctacaaacgaccgcgctccctcaaagggggggcaaccaacactatactacacgagccacgtcttaccaacaacagcgggttcaaacaaaccaccaggcgcgggcggcacaacaaaccaccaaactaccacgcgcagcaaatataattagcggcacaggacgtacggtagcgacgagaaacagaacgaaagtttttcgccgcgcgcccaccacacgacacgcggaggagacgtaatagtgaagcatacgtgtgtgaggacagaacaacaaccatttattttataatacccccgcgcgggagcctccctgcagccaggggaatgaacatagaatcacagaggacggagacagacagcagagccgccagaccaaacgaaccacgccaggccacaacgctcagcgcgcacgacacgaagagcagcgacaagcgagagagaacacagaagcgccggagcgccgagacaggagagaggcgggcaagcacggcgcggcacggagcacgaacacagtggacaacagaggacacgncccgcggggggacgtgagcaggcacgagccgcagagtgacagaggcagacgagagcaagcgacggacagagaaaacgtgaacgccgcgacactcaagcatacagaagagagacataggcgccaaggagagtagacaatcagcgcagacatggagcgacgacgcgatagcggcaaagcagaccgacgacgccgaatgaacaa

SEQ ID NO: 451598 - DNA, 1043 bp, Homo sapiens
  misc_feature (23)..(24): n is a, c, g, or t
  misc_feature (28)..(28): n is a, c, g, or t
  misc_feature (31)..(31): n is a, c, g, or t
  misc_feature (1043)..(1043): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaagaaacaaaaaaaaaaaagaaaaaagaaaaaaaagaaagaaaaaaaaaaaaaagtctggggggtttttttttggggggggggaagaaaaagagttaaaaagggggagcagggggtaatgtgtttccaagccccttttttgtgaaagaggggagaacgggggggccccatatgggggggttatttttttgtgtgcctgttttttatttttatttgttggtagaacagcagaaaataagagaggacagaaggaggagaaaaggagaagaggaaagaggaaaagaggaaagtagagaggacgaggaagggagagagcgacgaggtaggaaggagaggaaacgggaagagacagagacgggaggaggacagtaaggagaggacagaagagggaagcaaggaggagagaggagcgggaaaggaagaggcgagggaacatgagggagacgagggaaagaggggaggaggagcgagggggn

SEQ ID NO: 451599 - DNA, 1210 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaagaaaaaaaaaaaaaaaaaaaaaaaaaaaaaaaaaaaaaaaaaaaaaaaagggggggggggcgcctttttttttttttttttttttttttcttattgagtggtgttggtggacacagcccacaaatattgggggagcgagcgcaccccggtgaagagccggggcgaaaatacaaacagaagggtgggcgtcgaaccacacccaaccaggtcgggcagggggagccaacaaaccaatcgattccaagaagccgagcgaggcagaatggaaagctaagaactacggttgggggacatacactgaacaagagaggaaactaggattgtccaccacacgacaacaagcataacgaggagagagggaacaccacaagaagaaatatgcatacgggggagggccgaacaaaacacccccaccaaagcaggaggggggcaaaaaagccaccacataacatggggggggggtacgaacaacaggccccgctgtggccgcgaaacaagaggaagcaggctaaagggggcaatacagagcgcagcacacacgcagcagagagggacgagccaagcagaggacagtcccgcggggacagcaagggagagcaaatgagggcccccaaagtcagggacgacg

SEQ ID NO: 451600 - DNA, 906 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaactaaaaaaaaaaaaaaaaaaaaaaaaaaaaatttttgggcggcctgggccctgaagaaagctctcataaacccaactcggttgtgggcagcgggggcccaagttgaggataacgacgacaatgggctaacaacggggtgttcccaagaggaaaacccggggcccaggacaaatggaggacgaggagattttctcaccacattaataaaacacgcgcccggggagtaaaacccaggagacgtgttctagaacaaacactccaagaggtaggattcataggaggggccaaataaggggagtgcttatacaacaggagagttaccaacgaagagcctgagtactacaatttaacggccccggcgcgggtgggc

SEQ ID NO: 451601 - DNA, 519 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccagctgacggtgacttcaagatcaaatgtgtggcctttgactgaaatcagccagcccatggccccccaataaaaggcagctgcctctgctccctctgaaaaaaaaaatattccatataaaagcagccgcaattcgagcctattt

SEQ ID NO: 451602 - DNA, 442 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagctgtaggctgtctatcccttcagccttgaagtgttgagaagtgtgcatcacctttgacaggccacctgaccgtaagctgccagatgatattcaggttcccaccgcttcctgaggccatactactgcg

SEQ ID NO: 451603 - DNA, 393 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgacgttggatgcagtcagcggcgttgggtgcagtcacgcgttggatgcagtcagcgcgttgatgcagtcagcgcgtgacgtagg

SEQ ID NO: 451604 - DNA, 389 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgacaataaaaggcagctgcctctgctccctctgaaaaaaaaaatattccatataaaagcagccgcaattcgagcctattt

SEQ ID NO: 451605 - DNA, 575 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaaaaaaaaaaaaaaaaaaccccgggggcctctatttggggggggggggaaaaaggggaaaaaaaggggccaggggaaaaggggtccgaccccattttttgggaaaaggggggaaaagcggggggccacaaaagggggggggaaaataaaaacggggtcctgtac

SEQ ID NO: 451606 - DNA, 388 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggaccccaaaagagcaaagaccccaaaagagcaaagacagcaaaagagcaaagacaccaaaagagcaaagaccaaaagagctcagaccccataagagctta

SEQ ID NO: 451607 - DNA, 1152 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaagaaaaaaaaaaaaaaaaaaaaaaaaaaaaaaaaaaaaaaaaaaaaaaaagggggggggggcgcctttttttttttttttttttttttttcttattgagtggtgttggtggacacagcccacaaatattgggggagcgagcgcaccccggtgaagagccggggcgaaaatacaaacagaagggtgggcgtcgaaccacacccaaccaggtcgggcagggggagccaacaaaccaatcgattccaagaagccgagcgaggcagaatggaaagctaagaactacggttgggggacatacactgaacaagagaggaaactaggattgtccaccacacgacaacaagcataacgaggagagagggaacaccacaagaagaaatatgcatacgggggagggccgaacaaaacacccccaccaaagcaggaggggggcaaaaaagccaccacataacatggggggggggtacgaacaacaggccccgctgtggccgcgaaacaagaggaagcaggctaaagggggcaatacagagcgcagcacacacgcagcagagagggacgagccaagcagaggacagtcccgcggggacagcaagggagagcaaatgagggcccccaaagtcagggacgacg

SEQ ID NO: 451608 - DNA, 868 bp, Homo sapiens
  misc_feature (23)..(24): n is a, c, g, or t
  misc_feature (28)..(28): n is a, c, g, or t
  misc_feature (31)..(31): n is a, c, g, or t
  misc_feature (290)..(290): n is a, c, g, or t
  misc_feature (293)..(293): n is a, c, g, or t
  misc_feature (296)..(297): n is a, c, g, or t
  misc_feature (300)..(300): n is a, c, g, or t
  misc_feature (302)..(302): n is a, c, g, or t
  misc_feature (304)..(305): n is a, c, g, or t
  misc_feature (308)..(308): n is a, c, g, or t
  misc_feature (311)..(311): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcacagcaagganggnggnnccngngnnacnagnagctgcctctgctccctctgaaaaaaaaaaaaaaaaaaaaaacctcgaagggcacactctagtgccgcgggcgccggaaaaacagagacggtacggaaaagggcccagtggccaataccgtgtcaccggaacccagtttcctggcccacaggggcgaaaaccgcgccgcggcccccccctaatcgcgggacgccgggaactcgaactctccgaaataagcccgggtgtaacccgcgtggccttacaaggaatccgcggcaaaaaaccccccccccacacacccacaccgcgagcccacaccgacccaccacccaccccgcaccacacgcgcaccggaaaatccaccacaagacggcgggacgagcaggccgagcgaataggcggcgcggtccacccgccggaccaaccccggccgactcccgaccacccactcgcccgccgcaaagacgcggtgaccgcacacgcgcttgtgccgcgtcgcggccccagcgctgcgtgaggagcctacctatgcactcgcccggcccccacatccgcaccccaactcacctacccaa

SEQ ID NO: 451609 - DNA, 348 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagaggtgagaagtgaagtcggggtggtgggcggcagggacgggcttggtccagcagggagggcgtggccggccaagcccacatctcctccctggccgggagcgggttaacggccagccgccgatgctgcgttttctgggtgactcacttcccccgcagggtctgggc

SEQ ID NO: 451610 - DNA, 260 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagttaggtgaccttggaccagtcaaccaacctcacctagcctcagtttgttagaaaaacaaggggggaggtggttgt

SEQ ID NO: 451611 - DNA, 718 bp, Homo sapiens
  misc_feature (23)..(24): n is a, c, g, or t
  misc_feature (28)..(28): n is a, c, g, or t
  misc_feature (31)..(31): n is a, c, g, or t
  misc_feature (622)..(622): n is a, c, g, or t
  misc_feature (625)..(625): n is a, c, g, or t
  misc_feature (627)..(628): n is a, c, g, or t
  misc_feature (630)..(630): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaaaaacccgggggcgtttttttcggggggggggaaaaanggngnngnaaggggcggggcaaggtgtttcctgggccccctttttttggacaggggggaattgcgggccccaaaggggggggggaaaaatgaaacg

SEQ ID NO: 451612 - DNA, 1751 bp, Homo sapiens
  misc_feature (23)..(24): n is a, c, g, or t
  misc_feature (28)..(28): n is a, c, g, or t
  misc_feature (31)..(31): n is a, c, g, or t
  misc_feature (1550)..(1550): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaaaaaaaaaaaaaaaaaacaaacaaaaaagaggggcgcgcgcgcgcgccaaaaaagatatctcccccgagagagggcgcccaaaagtgtatatcaggcatacaccccgggtattactcgctgagtaacacccaagagggggggccccccacaatagatgaggggcgagcgcgcactgaaataatatactaacggtgcgaggagacaagcagggcgcgcccgcaccgtctgtttacaacaaccagcgcgcgcggtggacaagcggggggcaaaacaaacggctggcgaacacacccagggggaggaacaaccctctgtgtgagcaaaggaggacgcacactcactactacccactgctcgggggggaggcggagcccaccaccacatatatgtgggggggccaacacaacaatacctcgtacctcaaacgaggaactatatctacaaacgaccgcgctccctcaaagggggggcaaccaacactatactacacgagccacgtcttaccaacaacagcgggttcaaacaaaccaccaggcgcgggcggcacaacaaaccaccaaactaccacgcgcagcaaatataattagcggcacaggacgtacggtagcgacgagaaacagaacgaaagtttttcgccgcgcgcccaccacacgacacgcggaggagacgtaatagtgaagcatacgtgtgtgaggacagaacaacaaccatttattttataatacccccgcgcgggagcctccctgcagccaggggaatgaacatagaatcacagaggacggagacagacagcagagccgccagaccaaacgaaccacgccaggccacaacgctcagcgcgcacgacacgaagagcagcgacaagcgagagagaacacagaagcgccggagcgccgagacaggagagaggcgggcaagcacggcgcggcacggagcacgaacacagtggacaacagaggacacgncccgcggggggacgtgagcaggcacgagccgcagagtgacagaggcagacgagagcaagcgacggacagagaaaacgtgaacgccgcgacactcaagcatacagaagagagacataggcgccaaggagagtagacaatcagcgcagacatggagcgacgacgcgatagcggcaaagcagaccgacgacgccgaatgaacaa

SEQ ID NO: 451613 - DNA, 694 bp, Homo sapiens
  misc_feature (23)..(24): n is a, c, g, or t
  misc_feature (28)..(28): n is a, c, g, or t
  misc_feature (31)..(31): n is a, c, g, or t
  misc_feature (568)..(569): n is a, c, g, or t
  misc_feature (582)..(582): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaagaagaagnnggggaaaaaaggnaccttcgaggggtggggccccggtcaccccaatttcaccccttataggtgaagttcgttatttaccaaattcaaactgggccccgtgggtttttaaccaacctggtcgttga

SEQ ID NO: 451614 - DNA, 777 bp, Homo sapiens
  misc_feature (23)..(24): n is a, c, g, or t
  misc_feature (28)..(28): n is a, c, g, or t
  misc_feature (31)..(31): n is a, c, g, or t
  misc_feature (630)..(630): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctaaaaaaaaaaaacaaaaacacaaaacacctttttggggcggtggggcctagaaaaagtttttaacaccattcttgngggcgcgggcccagtgttaggcacctgggccaccgctggcccaaggacaccgggcaggaccgggtggtttttccaaaaaaaccgcgggcacccgctgttgacacccagggcgtccgggcctagcggcttccacacggcccaggccta

SEQ ID NO: 451615 - DNA, 927 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaactaaaaaaaaaaaaaaaaaaaaaaaaaaaaatttttgggcggcctgggccctgaagaaagctctcataaacccaactcggttgtgggcagcgggggcccaagttgaggataacgacgacaatgggctaacaacggggtgttcccaagaggaaaacccggggcccaggacaaatggaggacgaggagattttctcaccacattaataaaacacgcgcccggggagtaaaacccaggagacgtgttctagaacaaacactccaagaggtaggattcataggaggggccaaataaggggagtgcttatacaacaggagagttaccaacgaagagcctgagtactacaatttaacggccccggcgcgggtgggc

SEQ ID NO: 451616 - DNA, 759 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcagagccttgccagattggatacagaatttccaaagttcatccaaatcgggcttcaaccttgggaaggtcatcgtactacgattggcagcattgacaggtcgacgttcgagagatccacaatgttgtggttctttgacttgaaagatcagcccaagtctccattggcaccccccaaataagaggggctatgcgtgccttcgtggttccccatcttgtaataaaaagcaatacatgtgtccaggtttatttaatggggggaggggcgcacaaaaccattgattatcccacccctttcggggcggccctaaaaaagaaaagtgtagatcacgcacatatttttcggggttactcatagtggtttcccat

SEQ ID NO: 451617 - DNA, 455 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcaggtgggctgcagaccggaaccggggaccagggacaggggctgggtgggctggggcggggctgggttagtgactagagaccttggccctgcctgctctttcc

SEQ ID NO: 451618 - DNA, 868 bp, Homo sapiens
tgctccagagaacgctgaaaagttgccaggacccgagacaagctgcccaggatgggcccttctagggaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaactaaaaaaaaaaaaaaaaaaaaaaaaaaaaatttttgggcggcctgggccctgaagaaagctctcataaacccaactcggttgtgggcagcgggggcccaagttgaggataacgacgacaatgggctaacaacggggtgttcccaagaggaaaacccggggcccaggacaaatggaggacgaggagattttctcaccacattaataaaacacgcgcccggggagtaaaacccaggagacgtgttctagaacaaacactccaagaggtaggattcataggaggggccaaataaggggagtgcttatacaacaggagagttaccaacgaagagcctgagtactacaatttaacggccccggcgcgggtgggc

SEQ ID NO: 451619 - DNA, 906 bp, Homo sapiens
  misc_feature (23)..(24): n is a, c, g, or t
  misc_feature (28)..(28): n is a, c, g, or t
  misc_feature (31)..(31): n is a, c, g, or t
aatatacggctaggtacgaggcnnggtngcngtctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagtgagttcttccagcaaggtgcgttcatgggatactgagtgacagattagtcagtcagtggggctggagctggccgaggtggcctcatgcccacccgttaccccagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaccggggggaatcaaatgccgggaacgcgggacacaccagagggaaaaacgaaggggccaaagagggcacaaaggcagtgataccccggaacccgacgatttcctgtggacacaggcgggaaaaaccgagcacgggaacacccaaaagaggagaaggcggaaataaatacacaaaacacccacggttaaacacgggaataatgaacaacgggcagaaa

SEQ ID NO: 451620 - DNA, 429 bp, Homo sapiens
gcccgagagagagagagagagagagagagagagagagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaaaaaaaaaaaaaaaaaaccccgggggcctctatttggggggggggggaaaaaggggaaaaaaaggggccaggggaaaaggggtccgaccccattttttgggaaaaggggggaaaagcggggggccacaaaagggggggggaaaataaaaacggggtcctgtac

SEQ ID NO: 451621 - DNA, 637 bp, Homo sapiens
gctgcaggaattcggcacgaggagagagagagagagagagagagagagagagagagagagagagagagagagagagagagagagctagagagagagagctcgtgccgtattcggcacgagttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttccccccctgggttgtttacaatgtttttttggccccgggttggcttttcctcttccttcctt

SEQ ID NO: 451622 - DNA, 2699 bp, Homo sapiens
cgctcatcgagggacgcccggcccaagtggctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatgtttttaaagtgatttgccattgttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttagaggggccttttcactttcgacttttttcattttgttctgttcgaattttttataagtatgtattacgaccccgaagggttttatgggaactaacatcagtaacctaacccccgtgactatcctgtgctcttcctagggagctgtgttgtttcccacccaccacccttccctctgaacaaatgcctgagtgctggggcactttg

SEQ ID NO: 451623 - DNA, 3762 bp, Homo sapiens
cgctcatcgagggacgcccggcccaagtggctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatgtttttaaagtgatttgccattgttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttagaggggccttttcactttcgacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgac

SEQ ID NO: 451624 - DNA, 2720 bp, Homo sapiens
cgctcatcgagggacgcccggcccaagtggctggggccaagccgcagagcggagttggcatttccagattggggctcgggccgcgcctcctccgggaccctccccttggaccgagccgatcgccgcggggcagttcgggccggctgtcctggcgcggtgaaggtgataaagtaaagtgctttcactgtggaggagggctaactgattggaagcccagtgaagacccttgggaacaacatgctaaatggtatccagggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaataccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatgtttttaaagtgatttgccattgttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttagaggggccttttcactttcgacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgac

SEQ ID NO: 451625 - DNA, 2853 bp, Homo sapiens
cgctcatcgagggacgcccggcccaagtggctggggccaagccgcagagcggagttggcatttccagattggggctcgggccgcgcctcctccgggaccctccccttggaccgagccgatcgccgcggggcagttcgggccggctgtcctggcgcggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatgtttttaaagtgatttgccattgttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttagaggggccttttcactttcgacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgac

SEQ ID NO: 451626 - DNA, 3676 bp, Homo sapiens
tgctaatagctttgatgatcgtttcttggtgactgctggagcagatggcaatatctttgttttcaacattttttctgaatttatgctaaggaaagacatgaaggccaaagttccatctcccaggtttggaattgaaacagagccaattccagaagacattgaagatcccaaagcctacagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagattttgatgtagattcccaaatccgtgctgagatgcacagaaaaacagctttcaaaattcaacaagtggaaaaggaattagcttgggaaaaagagaaacatgaactcggcctaatgaagctaaagaatcgatttcgagatccactggaaagtgatactattgtggttcatgccatactgagtgaccacaagatatcctcttacaggctggtgcagccctctaagtactccaaattcaaacgagctagtcaatcagagagaaaaccaagcaaattggacaggtttgaaaaagagggacctggaagaaaggacagccagagagatgcaggtgggagtgttaccatacaagaagaatcaataatagaaaaagggaagaaatttcggcctaaaaccctaagtgaaatcatcgtggaaaatcaaattgagaaaacgagaaaacttatattaaaagctgaaagggcacaactaaagattcaacagcgaaaaaaagaatgggaggaactatacaagagtaaacctggtgatgactatgaagatcccaaagatcttcaagccatcaaagaagcccaggtgtatatgggagatttcaatctgaagacagccccagactacaagatacctgagcacatgagaataaatgctgccaagaaggaagaggaactaggacacctagattctttggtccatggaaataaaaggcacatgaacaagtgcattctctctcttagagaccttaaagtggctgttgttgaggaaatacagtgcctggtacaagaactgaagaacattcagtcgactcttcacatatccaagcacatacccattcccaaaattcctcagatacacccagaagaagttccagaaaagagatttcagtatgatgaagaaactctcctaaattttaagcaacagcaaatgaaaagtaaagatgaaaagtcccccggagtggaacagacagggtctggaggcccagttggaggattcctcaaactctcttctagaaaggatggggatttgacaacccgtgattcaatatctagatcatcaaaggcatcaacattcagcctagatataccaaagtgtttggaatttgaaaaagcagagccaacggatgtggagctggaaattatgaagagagacgagattaaacacgtgtacatgcaacagtatttggtcaacaggatcaaagaactggttgtcactttcgatgcagaactccgtctccttagacatcagaaactaaaactagatactcagatgaaattatctgacctgcaccatgtcaccttatttcaagaaatacttctcctgaagaattttgaaaaacaggagaacatacttcaagaacgtgttaattccttagacaaagaggaacagtacatgcaatggaaaataaatgaaactcttaaagagatggaagagaaaaagaatgaaatcaccaaactccaggagcaagaaaaggcactctatgctggttttcaagcagccattggagaaaacaataaatttgcaaacttcctcatgaaggtcctaaagaagaggattaaacgggtaaagaaaaaagaagttgaaggagatgctgatgaagatgaggagagtgaggaatcaagtgaagaagaatctagcttggagagtgatgaagatgagtctgaatcagaagatgaggtttttgatgattctatttgcccaacaaattgtgatgtggctctttttgagctggcccttcaccttcgagagaaaaggctggacattgaggaggctttagttgaagaaaagaaaattgttgataacctcaaaaaggaatatgatacattgtcaaaaaaagtgaaaattgtggcaactaatctgaatgcagcagaggaggccctggaggcttatcagcgagagaagcagcagcggctgaatgaactgctagttgtgattccgctcaagctccaccagatagagtatgtggtatttggagaaatacctagcgatctttctggtactttggtcttctctaaccatgccttgagacggctgcaagaacgaatccgtgagctccaggaggaaaattccaagcagcaaaaacttaacaaagaatggagagagagacgtaaacagctcatccgagaaaagagagaaatgacaaaaaccatacacaaaatggaggaaacagtccggcagctcatgatcagcaagtttggccgtgtggtaaatctagaagcccttcaaacgctttctgttaatacaacacttgaagaactgaagatcagaaaacttcgaaaggagctagcaaatgcgaaagagatgaagatgtgggaggaaaagattgctcaaatgcgatgggaactgatgatgaagacaaaagaacacaccagaaagctttatcagatgaatgatttgtgtattgaaaagaagaaacttgattctcggttgaatacactacagaatcagcagggcaatgccttccagggccctcgggaagcagatgttgtggcaagagaggaggtcactgaattgatccaactccaggcggaaaggatttcggccttaaaggaggagattgctcttttgcgtaggaaaggcggtcttatcctcccacccattcagtctccacgagagaaagagatacagcccgcagacctttgagtttgctattttctcaaacccatacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaag

SEQ ID NO: 451627 - DNA, 4509 bp, Homo sapiens
tgctaatagctttgatgatcgtttcttggtgactgctggagcagatggcaatatctttgttttcaacattttttctgaatttatgctaaggaaagacatgaaggccaaagttccatctcccaggtttggaattgaaacagagccaattccagaagacattgaagatcccaaagcctacagtatcgagaatgctaggagaaaaagagaacatgacaagttaatgaaagaagtgggagaaataaaggcacggaagagagagcaaatcaaagctttgaggagtgaattttgtaatctattagaaatgaatgaaaaattaccaaagcatatgcagtttaaacgaacagattttgatgtagattcccaaatccgtgctgagatgcacagaaaaacagctttcaaaattcaacaagtggaaaaggaattagcttgggaaaaagagaaacatgaactcggcctaatgaagctaaagaatcgatttcgagatccactggaaagtgatactattgtggttcatgccatactgagtgaccacaagatatcctcttacaggctggtgcagccctctaagtactccaaattcaaacgagctagtcaatcagagagaaaaccaagcaaattggacaggtttgaaaaagagggacctggaagaaaggacagccagagagatgcaggtgggagtgttaccatacaagaagaatcaataatagaaaaagggaagaaatttcggcctaaaaccctaagtgaaatcatcgtggaaaatcaaattgagaaaacgagaaaacttatattaaaagctgaaagggcacaactaaagattcaacagcgaaaaaaagaatgggaggaactatacaagagtaaacctggtgatgactatgaagatcccaaagatcttcaagccatcaaagaagcccaggtgtatatgggagatttcaatctgaagacagccccagactacaagatacctgagcacatgagaataaatgctgccaagaaggaagaggaactaggacacctagattctttggtccatggaaataaaaggcacatgaacaagtgcattctctctcttagagaccttaaagtggctgttgttgaggaaatacagtgcctggtacaagaactgaagaacattcagtcgactcttcacatatccaagcacatacccattcccaaaattcctcagatacacccagaagaagttccagaaaagagatttcagtatgatgaagaaactctcctaaattttaagcaacagcaaatgaaaagtaaagatgaaaagtcccccggagtggaacagacagggtctggaggcccagttggaggattcctcaaactctcttctagaaaggatggggatttgacaacccgtgattcaatatctagatcatcaaaggcatcaacattcagcctagatataccaaagtgtttggaatttgaaaaagcagagccaacggatgtggagctggaaattatgaagagagacgagattaaacacgtgtacatgcaacagtatttggtcaacaggatcaaagaactggttgtcactttcgatgcagaactccgtctccttagacatcagaaactaaaactagatactcagatgaaattatctgacctgcaccatgtcaccttatttcaagaaatacttctcctgaagaattttgaaaaacaggagaacatacttcaagaacgtgttaattccttagacaaagaggaacagtacatgcaatggaaaataaatgaaactcttaaagagatggaagagaaaaagaatgaaatcaccaaactccaggagcaagaaaaggcactctatgctggttttcaagcagccattggagaaaacaataaatttgcaaacttcctcatgaaggtcctaaagaagaggattaaacgggtaaagaaaaaagaagttgaaggagatgctgatgaagatgaggagagtgaggaatcaagtgaagaagaatctagcttggagagtgatgaagatgagtctgaatcagaagatgaggtttttgatgattctatttgcccaacaaattgtgatgtggctctttttgagctggcccttcaccttcgagagaaaaggctggacattgaggaggctttagttgaagaaaagaaaattgttgataacctcaaaaaggaatatgatacattgtcaaaaaaagtgaaaattgtggcaactaatctgaatgcagcagaggaggccctggaggcttatcagcgagagaagcagcagcggctgaatgaactgctagttgtgattccgctcaagctccaccagatagagtatgtggtatttggagaaatacctagcgatctttctggtactttggtcttctctaaccatgccttgagacggctgcaagaacgaatccgtgagctccaggaggaaaattccaagcagcaaaaacttaacaaagaatggagagagagacgtaaacagctcatccgagaaaagagagaaatgacaaaaaccatacacaaaatggaggaaacagtccggcagctcatgatcagcaagtttggccgtgtggtaaatctagaagcccttcaaacgctttctgttaatacaacacttgaagaactgaagatcagaaaacttcgaaaggagctagcaaatgcgaaagagatgaagatgtgggaggaaaagattgctcaaatgcgatgggaactgatgatgaagacaaaagaacacaccagaaagctttatcagatgaatgatttgtgtattgaaaagaagaaacttgattctcggttgaatacactacagaatcagcagaaccctggaaatggtctaagctaagtgttccaacagtttggtcctctgaagaagagcatcagcatcacctgggaacttgtttaaaatggcaatgccttccagggccctcgggaagcagatgttgtggcaagagaggaggtcactgaattgatccaactccaggcggaaaggatttcggccttaaaggaggagattgctcttttgcgtaggaaaggcggtcttatcctcccacccattcagtctccacgagagaaagagatacagcccgcagacctttgagtttgctattttctcaaacccatacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaagaggcttttctttaaagatttctgcaactccgtcagaattctaagttttccccatagtttctcatgttccctgccattttctttcaggttttacttgggccatttgctggttttgatatagatgaggagataatgaaatagatttactagagatcatctttaacaatcacctttgattatgcataacattttaaactaattgaagagtatccttttggtttgggggtaagtgctcattgaagttcatggctataaccattgcaggataatctcactgacatttggaatcctgttagtaacagagcatagctctttagattaagagctctgtattaacgagctactcattgaggctgttccaggataagctggtcactgagaagggcgggtgaagaaaggaacattgcataaatgtagaagggaactcagcaatgccaagtcttcctcacctgtgattagcctgctaatgtgccccccaaaattacagacaggtcttgctttctttgtacatcacaatattcttagaggtggccacttggcctattgtcttcctaagattccttcatattcctatttaagaggtcagaataccttattgtttgcacttgtcaccattaatttctgatgtagtcacttctctactggagagcacccacttttttttttaaatcactttctgtgttgtatatcctaagccatgtgtgcctttcaagtatttttaaaaatatgctagtcataaacctgagt

SEQ ID NO: 451628 - DNA, 143 bp, Homo sapiens
tgaagatgaggagagtgaggaatcaagtgaagaagaatctagcttggagagtgatgaagatgagtctgaatcagaagatgaggtttttgatgattctatttgcccaacaagtaagttagataaaaccacgtgttctctgtgaa

SEQ ID NO: 451629 - DNA, 1849 bp, Homo sapiens
ttgcacttgaagagttgtttattagcccaaaggcacacatttctaatggtgggattttagcagaggaattgaaggctcccgagattaaggaacagtggctgtttagggtgactgtcaggccagcactcatcacagatacacagtataagggcatggagtttttcacatgccaaatgatgcttcaacagggagctgttttctttcaacagggcaatgccttccagggccctcgggaagcagatgttgtggcaagagaggaggtcactgaattgatccaactccaggcggaaaggatttcggccttaaaggaggagattgctcttttgcgtaggaaaggcggtcttatcctcccacccattcagtctccacgagagaaagagatacagcccgcagacctttgagtttgctattttctcaaacccatacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaagaggcttttctttaaagatttctgcaactccgtcagaattctaagttttccccatagtttctcatgttccctgccattttctttcaggttttacttgggccatttgctggttttgatatagatgaggagataatgaaatagatttactagagatcatctttaacaatcacctttgattatgcataacattttaaactaattgaagagtatccttttggtttgggggtaagtgctcattgaagttcatggctataaccattgcaggataatctcactgacatttggaatcctgttagtaacagagcatagctctttagattaagagctctgtattaacgagctactcattgaggctgttccaggataagctggtcactgagaagggcgggtgaagaaaggaacattgcataaatgtagaagggaactcagcaatgccaagtcttcctcacctgtgattagcctgctaatgtgccccccaaaattacagacaggtcttgctttctttgtacatcacaatattcttagaggtggccacttggcctattgtcttcctaagattccttcatattcctatttaagaggtcagaataccttattgtttgcacttgtcaccattaatttctgatgtagtcacttctctactggagagcacccacttttttttttaaatcactttctgtgttgtatatcctaagccatgtgtgcctttcaagtatttttaaaaatatgctagtcataaacctgagt

SEQ ID NO: 451630 - DNA, 1014 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451631 - DNA, 1132 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaacaacacaaacaacaaacacacaaaaaaacttggtgggggggcccgggccccgaaaaggtttttaaaccaatcgtgggcgcgcggaggccccagagggcaacgcgacgccggcccctca

SEQ ID NO: 451632 - DNA, 155 bp, Homo sapiens
  misc_feature (27)..(27): n is a, c, g, or t
actcctcctcttcctcaagctccctgnaaggggtctcctccatctcctgctctggtgtcctacagtacaatcagcagtctagttcttttcatttggaatgaatacagcatttagcttgttccactgcaaataaagccttttaaatcatcattcaa

SEQ ID NO: 451633 - DNA, 1160 bp, Homo sapiens
  misc_feature (1085)..(1085): n is a, c, g, or t
  misc_feature (1126)..(1126): n is a, c, g, or t
  misc_feature (1138)..(1138): n is a, c, g, or t
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaataccaaaaaaaaaaaaaaaaaaaaattgggggggggccgaaaatttaaacacttggggggggccaagagangaaaggcaaggcacagaacgggaagagggggtcccaaaacngggggggggaanaaggggggggggacaggaggat

SEQ ID NO: 451634 - DNA, 1108 bp, Homo sapiens
  misc_feature (1042)..(1042): n is a, c, g, or t
  misc_feature (1058)..(1058): n is a, c, g, or t
  misc_feature (1061)..(1061): n is a, c, g, or t
  misc_feature (1064)..(1064): n is a, c, g, or t
  misc_feature (1068)..(1068): n is a, c, g, or t
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaataccaaaaaaaaaaaaacaacaaaaaanacatttgtggggcccncgngcncccnaaaaaattcctcaaaaccccgctgggggcgcgcggggcca

SEQ ID NO: 451635 - DNA, 1111 bp, Homo sapiens
  misc_feature (1022)..(1022): n is a, c, g, or t
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaaccaaaaanaaccaacgctggaaacaaacgtgcgcgggccgcctgtccccagagagagtttggaacacttggtgggcgcgcgggccactgtaatgtaa

SEQ ID NO: 451636 - DNA, 1163 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaaaaaaaaaaaaaacaaaaacaaaaaaaaccaacaacacaaacaacaaacacacaaaaaaacttggtgggggggcccgggccccgaaaaggtttttaaaccaatcgtgggcgcgcggaggccccagagggcaacgcgacgccggcccctca

SEQ ID NO: 451637 - DNA, 1739 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaaaaaaaaaaaaaaaaaaaaaaaaaaaaaaaaaaaaaaaaaaaaaaaaaaaaaaaaaaaaaaaaaaaaaaaaaaaaaatgggggggggggggccggcgcggccagaaagaaattaaacaccgggggggggggggggcccaagaagcaaaccagtgtcacaccatcgtttccccagaaaaacatcggggtgaaagcaaggcgggggggggtcttccccaccaaaaaaaaagcgcgcgcgggggaacacccccagagggtctttcaaacacaccacacgaggaggcccgggcgcacacgggcggggtcccaaaaccagggagcgacccccagagcgggcgccggctaataaaaaatagccacccgcaccgcaggggacaccatcagactcacctgccacagcatcattactatgcaccatcactacacaatcacagtccgggtgcacagcaagagccaccgacaagtacatcatcaacagcagcagacctaagcacaaagcgctacccacacaccacccacacgaacaacaaccaccagcaacccaaccacccaacccagcacgcacaagcaccgacaagccaggaacgcaccaccctagacacgcaaaaaccacaccctagcagacccacaccacgccccaaccccaaccaaccaccacacccccaacttcaccatcaccccacccacgtgccccacggacgaaaagcacaccccagaacctacgaaa

SEQ ID NO: 451638 - DNA, 1079 bp, Homo sapiens
tttaaaaggctttatttgcagtggaacaagctaaatgctgtattcattccaaatgaaaagaactagactgctgattactgagaactcataagacgaagctaaaatccctcttcggatccacagtcaaccgccctgaacacatcctgcaaaaagcccagagaaagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451639 - DNA, 696 bp, Homo sapiens
gttcctcttctttgtatctgtcgtttttgtttggtgtgtttcgttctttttctctctggtctgcctcatcaagttacaacgagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451640 - DNA, 685 bp, Homo sapiens
tttaaaaggctttatttgcagtggaacaagctaaatgctgtattcattccaaatgaaaagaactagactgctgattactgagaactcataagacgaagctaaaatccctcttcggatccacagtcaaccgccctgaacacatcctgcaaaaagcccagagaaagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451641 - DNA, 873 bp, Homo sapiens
tttaaaaggctttatttgcagtggaacaagctaaatgctgtattcattccaaatgaaaagaactagactgctgattactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggagacagggtttcaccatgttgcccaggctgctctcaaactcctgagctcaagcaatccacccactaaggcctcccaaagtgctaggattacagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451642 - DNA, 769 bp, Homo sapiens
ggcagtatagtgtgaactcataccagcgaagttatgttcccttcttctcgtgatccacggttctaacctgttcctgatcacaggtcctgctcaaaagtctcctagaagaaaaggagctgccaattgcgaagttactgacacgaataatatgagtgccagtctgagtcttctatcgtggctcaccatatgctcttgggtgttgtctttgcatgcttgtccagtacctgaatgcatgcacttattgtaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451643 - DNA, 628 bp, Homo sapiens
tttaaaaggctttatttgcagtggaacaagctaaatgctgtattcattccaaatgaaaagaactagactgctgattactgagaactcataagacgaagctaaaatccctcttcggatccacagtcaaccgccctgaacacatcctgcaaaaagcccagagaaagattgcccagaatgcacgctacaggaaaacccattatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451644 - DNA, 1198 bp, Homo sapiens
  misc_feature (851)..(851): n is a, c, g, or t
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttaggcaaaaaaaaaaaaaaaacaaaaaaaaaaantttgtgggtgggcctggcgcttgggccccggcgagaaagagcttttagtgacaacattcggtgtggggcgggccggggccccaagaagggtaagagtgaacaagtgggcacaaagagcggtgttcccgagggagaaaccgcgggcacagaaccaatagggcggtgggaatttcaccaccaaataaaaaaacacgcgcgcaggggaggaacacacgagagggcgctcttggaacaaaactctcacagagggagagtactcgaggggcaaaaacaggggaggaccaagaccaaggggggggcccaaggaggaggcccagaaaaaaaatatgagccccggcctggggggc

SEQ ID NO: 451645 - DNA, 2389 bp, Homo sapiens
  misc_feature (673)..(673): n is a, c, g, or t
  misc_feature (941)..(941): n is a, c, g, or t
tttaaaaggctttatttgcagtggaacaagctaaatgctgtattcattccaaatgaaaagaactagactgctgattactgagaactcataagacgaagctaaaatccctcttcggatccacagtcaaccgccctgaacacatcctgcaaaaagcccagagaaaggtaatatgaatgaaataattttgggggactttaattgaggagtaaaatatttgagaatatgaggaagattccaaagtctctgcatataccttaataagaactgagacaggcttttactcattctcttttcagcacttatgattgaattagaaggaagtctgtaaaatttggctgtgatcatagggtaagatgttatctaacagaagccagaaacccaatgtctcctgctgagatgcttgagtgcctgtcaggatctaaaaattttcctcaagaattactgtatgtcattggaaagacgttcttttgagtggcttccaggagccagacagagggcaagtagacattatgatattgttttattatccatttttaagtgatgtatagctatatcttcaagctggcccatgataaagtggttcacttgttcagctgaatgactatagcttctgattatcttttgaatagatgttctcatgcagacttgaatagtagcatggaatttcttgaangtcgttgttttcatttttcttctttaataaaatgctacaaaaatcaaagttggtagtatttctctagctattattcatgaatttgcaatgataagtcacttgcccaagtctaattgattagttccaatgagtttctggaaacttttttgcagctaaccttggttatcttagcattagcattaattggtggctgattgggaaatagacactagaaaataaaagaccttttttgtccctccttattagcgttgaagaataggctatgggnacgtgtgaagaactatgggctgacactatatgggtcccttaggaatgcagaagctccctttcatctctgtagatattttgtttcttaagctcttcaatctttttcccagtcaaaagtcagatattttgctttaggaaaatatcttttaaataattacttgacttaataccaattcaattattcataatattggtcaaccaaattgcatgtaatacattgctatattcttgaattatttaaaaaagacaagagtggtcatcatttataaaaggttcgtggtttttcatgttaatttcaactttggttttcttaagtttattattttttttgcagtaagagtcattgaaattttaagtgagtcatattccttaccatttcctgctgaaaagggtagtgtgtgagaaaaatgttagaaaagcaattaattatgttccagagcagattttcagttgcagtgtacatttctttttaatgtgagacccaaatttacatgaaaactcaaagtaagagctgggtaacagaaatggctaacttagaaggtaatgtacgtcttgcttaaaagcacatcaaagtaatctactttctcaaagagaaaatttacaggagtgaacttacatttcttttgagaacagcatggttcatagcaccaaacttcatttttacaggttgtgaatcctagagtagtttgctatcaacttctgatctttgcacattctggatttggcatataatgttacagcagtgccattgtaatgttgcacaaagtagtctagcaatttcttggttcaccaggcttagagataacattgtagaaatgatccagcatctttaacactctgtggtttaaggtggggcacttaggggtagaatcaataacaatgttagaaatcaaattagacaagataactgaaacagcatgatccatgtgtgactccaagttataaaggaggacatggattaatggtatacttctaggctataggggtagtacaagtggaaggacaccatcttagcatcagatcactttctgagcaactttggcaaatcttttaaattctctaatgtgtagttttttaatatatgacacaggtgtaaagaaaataaagcaagtgaatgtatgtgaaagccaatgctgactgggcacgggggctcacgcctgaaattctagcactttgggaggcagagccggggatatcacttgagcccaggagttgaagatcagcctgggcaacatagagaaaccctgtctctacaaacaaaacaaaacaaaaaaacaaacacaaaaaaccactcccaaattagccgggcttgctggcacactcctgttgtcccagttacccgggaggctaagatgggaggatcacctgagcttgggaagttgagactgtaatgagccgtgatagtggcactacactccagcctgatccacagagtgagaccatgtctca

SEQ ID NO: 451646 - DNA, 462 bp, Homo sapiens
  misc_feature (453)..(453): n is a, c, g, or t
tttaaaaggctttatttgcagtggaacaagctaaatgctgtattcattccaaatgaaaagaactagactgctgattactgagaactcataagacgaagctaaaatccctcttcggatccacagtcaaccgccctgaacacatcctgcaaaaagcccagagaaagagcgccatgtgattaactcaacaagggcaaaacaaacaaaaaatttttttaattttgggccaaaggggcgtttaaaatttcccttttttttcccttggggtcacattgtcggtgtttctgcatgttctccattccgcccctgatgtgcaggattgcccagaatgcacgctacaggaaaacccattcttctcccagccgcggttggccccccccaaaaagttaactttcaaggtgggccaattgggggccttgggctggctttcttcttaggaagccattatttcccacntccactaaa

SEQ ID NO: 451647 - DNA, 780 bp, Homo sapiens
tttaaaaggctttatttgcagtggaacaagctaaatgctgtattcattccaaatgaaaagaactagactgctgattactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451648 - DNA, 1025 bp, Homo sapiens
aaccgagtgctggttgtctatggcgtgtgtgagctcttgtgttgtgcttgcgtggctacgatagtgttggttgaggtggtggggtgttgtggcgatgtgcatgtagatggggtagttgtgaaagagaaaaataacgtagaatgatgcgtgcgtttttatcagatgctcctctcgtcttgtcgggaatttagcgggagccccttgtagcttcgatgtcttttggacgtttatgtcttcacaaccgttcccccgctagtttccttggtgagtgtgtgtcccgggggagccccacttagtcctcgccgattcgcccgattagctactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451649 - DNA, 1208 bp, Homo sapiens
  misc_feature (1047)..(1047): n is a, c, g, or t
  misc_feature (1049)..(1049): n is a, c, g, or t
  misc_feature (1051)..(1051): n is a, c, g, or t
  misc_feature (1058)..(1058): n is a, c, g, or t
  misc_feature (1063)..(1063): n is a, c, g, or t
  misc_feature (1067)..(1067): n is a, c, g, or t
  misc_feature (1069)..(1069): n is a, c, g, or t
  misc_feature (1076)..(1076): n is a, c, g, or t
  misc_feature (1086)..(1086): n is a, c, g, or t
  misc_feature (1088)..(1088): n is a, c, g, or t
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaaaaaaaaaaacagcacaaaaacaaatttggggcngntnggccctnaaaangttntnaaacccnttgttggggngnggccccattgtctacgggcaccgtggctaatacgtgtcccaagagagactggccatacacacgtggtgtggtctctcccgaataaaacgccggggtgaacagcaggctttgtacacttcg

SEQ ID NO: 451650 - DNA, 1058 bp, Homo sapiens
  misc_feature (1026)..(1030): n is a, c, g, or t
  misc_feature (1033)..(1038): n is a, c, g, or t
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaaaaaaaaaaaaannnnntannnnnntttttttttttttttttttt

SEQ ID NO: 451651 - DNA, 1392 bp, Homo sapiens
  misc_feature (1045)..(1045): n is a, c, g, or t
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaagcaaaaaaaaaaaaaaaacaaaaaaaaaaantttgtgggtgggcctggcgcttgggccccggcgagaaagagcttttagtgacaacattcggtgtggggcgggccggggccccaagaagggtaagagtgaacaagtgggcacaaagagcggtgttcccgagggagaaaccgcgggcacagaaccaatagggcggtgggaatttcaccaccaaataaaaaaacacgcgcgcaggggaggaacacacgagagggcgctcttggaacaaaactctcacagagggagagtactcgaggggcaaaaacaggggaggaccaagaccaaggggggggcccaaggaggaggcccagaaaaaaaatatgagccccggcctggggggc

SEQ ID NO: 451652 - DNA, 1211 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaaaaaaaaaaaaaaaaaaaaaaaaaaaaaaaaaaaaaaaacaaaaaaacaaaaaaaaaaaaacaaaaacaaaaaaaaccaacaacacaaacaacaaacacacaaaaaaacttggtgggggggcccgggccccgaaaaggtttttaaaccaatcgtgggcgcgcggaggccccagagggcaacgcgacgccggcccctca

SEQ ID NO: 451653 - DNA, 683 bp, Homo sapiens
  misc_feature (21)..(21): n is a, c, g, or t
  misc_feature (41)..(41): n is a, c, g, or t
cgctggaacgaatcaaacagngacacaaccaaacaccctcnagggaaacgcatggcattactcttgagagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcctacagtacaatcagcagtctagttcttttcatttggaatgaatacagcatttagcttgttccactgcaaataaagccttttaaatcatcattcaa

SEQ ID NO: 451654 - DNA, 1054 bp, Homo sapiens
aaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttacttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatacagcctttaactttcttagtgcctgtgaaagtgctaggtttcacagagttattttgttgaggtatgtcatagtgaaacaatggagaaagcaaatgcaaatacattaaaatttttagccagtacagctaccttccgc

SEQ ID NO: 451655 - DNA, 787 bp, Homo sapiens
tttaaaaggctttatttgcagtggaacaagctaaatgctgtattcattccaaatgaaaagaactagactgctgattactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtaagaacctcaagatccccagaagctttctaacagcccaatcagagaaatgttcatagagcccacccatggaatttaatgccaaaggtgtctaatgacccagcctctgtcgagcatttgtacaggtggggaatacatttctacccattaattaaaagagtcaattgtcttgtgggtatagactggatttattcagaatgaggagaataggggtagaggtgacaaggggcaggttgggagaaagtacagcttacttgtgctaaaaatatttcctaaaaaggagactgtgcaaatgtagtatgcatctacttatttcagcagaatgcaaacaattttatgtaat

SEQ ID NO: 451656 - DNA, 2964 bp, Homo sapiens
  misc_feature (1366)..(1366): n is a, c, g, or t
cgaataagttaattgttttattgttaaaacaaaggcttttgggggtgagtatctgctctatgaaaaatcttctagagatcttggtattaaaaatgtaaaaattttatcattgccattaggaaaactggtagataggctgaataacaaaacagttgcaacttaggagaaaaacagtgagcccaaagactgaacataaggattttttaagttttatggtagcataaagagatataaagtgtatgagaaaaccagtagagatctagaagttctttctggtatctaagaagaatttcagaatttaattaagacagaatgaagggaggagtatttttaagaggtaactaacataatttttatgatcgtccatacagatttggcaatttctacttcctttaattgcagtacctggtgtgtcataagcaatttttacaagtacagtcattttttgttttcccatttcagtgttgtagcatgaaacgattttcagtgatgagcaacctaatttaagtgaacatccatttttaatgctaccacataaggaaatagagctatgattatgattaacaactatgttctatgcaagggtaaccccagacatatgcagctccgtcataactgactcctttgtctggaactatgtcttttatacaatgaatgtgaagtccttcaattttcataaaagatacagttgacattatttataatatagaagtgatggcatgataatacagaaaattaataataattattcaacagaagttcccagccataatatcacttctgaaaaataatgcatgctagtattttttgagaatctgtaatggcttgacacttagctaagcagttaactgctttcatcatattattttatgtaagtctgttttagtctgtgcagaacgctatagaaaaataccatacactgggtaacttataaacaaatttctttctcacggttttggaggctgagaaatcaaagatcaagtcatcagcagattcagtgtctgctgaggggctttttccttgtagactaatggttgcatctagctgtgtcttcacaacccatgatgcaaggggcagggtagctctctgggacttcttttataagagcaccaattccattcataccatttatgcccccatgacctaatcacttctcaaaggcctcacatcctgatactatatgaccccatacctgataccttgggaatcagaatgtcagcatatacatttgggaggacacaaacattttgatcataacaaggtcctagaaaagaaaattgaaatcacagaagtagatttgattatttaacatttgcatctagattgccaacattttatttctgttaatgagtttgcaaattcaacnctgttagagcgataccagcttcataccatcccacagaatcaggagagattttcttgaaactgcttcacagcccagcttctctctcttcacttccacttccatctctgcccagcaagtgttgatcccaagagcatttcctaataaactccttggaaattaatctgtctctgtctcagagtttgtgtctcaggagatcaaacctataaaagtgttccagaatgaacaaggaggttatcaaaaaaaaatacaggcataaaaacaatctgttaatctttgattggcgtataactctgagacaattctccccatgtaaataatgcctaggtgtgctacatttagtatatgaagaaaaggtaaagactcagttatagggcagaacacaggtggctcacgcaagtcatctcagcactgtaggaggccaagacgggaggattgcttgagcccgggagttccagacccgccttggcaacacagtgagacccagtttcataaacaaacaaacaaacaaaaaaagcaaaaaagcacccagttgtagagcaatatgatttttccaacagagggagacaaaatttaaacataagctttaatgccaaatgtcagagaaccattttaattttcacattggtccaattatatatgttgacacattttattaagtattttactcacacaatttcacttacaaatataaaaatatatagaaaataaaatatagatactattataagcttgaggttaatgatatactaaaacattaaaggatgtttataatatcattctgattgctcacaaatatttggagagaatttaataaacaatacatttgtggctacattaacacaactacattacattaatatgacatagagatgaaaaagaccaagttagcttgtgaaaaatgaattcaagaatgtggatgagtttcttagttcagaattgctcaggaattgggacattatgtaggtaagattctggaaagggcaaaaggatgaaaaacaagagaaggcctaacccatctgctacttgattatcttaatgaagcaaatctagagatttattaaagtaactcttgcttattgagcaccatatttaacacaaactatttagctttaaggcaacagttatcatcataatttgcttaaatttttaggagtttactcataaagctttgctttcagtgagataaggccggatgggcaaagagtaaactaccctgcaaatatatgcggataatttaattggtttcatattacaggaatctagagggccaattactttttcagtaataaaaaaataaaagggccagatgcagtggctcatgcctgtaatcccagcactttgggagtccaaggcagagagatcgcttgagctcagcagtttgaaaccaacttgggcaaaatgagaaaacacccatctctaaagaaatatataaattagacagaaatggtgtcatgtgcatgtagtacttgtattcccagctacctcaggaggctgaggtgtgaagatcatttgagcctggagaggtcaaggctgattgagccatgatggtgccagtgtacttcagcctgggtgacagagactgtctcaaaaaaaaaaaa

SEQ ID NO: 451657 - DNA, 3597 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagctcaagaggtgaggaaattgtccgcctgcagatcctgacacccagggcaggactccgcctggtggccccagacgtggaaggcatgagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451658 - DNA, 3714 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451659 - DNA, 3891 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451660 - DNA, 3801 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451661 - DNA, 3507 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcaggtcttccccaggcaacaaagacaaggaggccccctgctccagagagctccagagggacttggctggtgaggaggctttcagggcccccaacacagatgctgcaagctccagtgccacttcagtctctgctgtccctgctgataggaagagcaacagcacagcagcccaggaggatgcaaaggcagacccaaagggcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451662 - DNA, 3666 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451663 - DNA, 3875 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatccaaccaaacaccccacaatcacaaaaaagggggggggcggcaaaaatttcccccggagggccccatttccgcccccctttttttgacaaaggggccccaaagggggggtaaaaaaaggagggcgcggttaaaaccgtcggccgggcaaaacgccccgggct

SEQ ID NO: 451664 - DNA, 3615 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451665 - DNA, 3897 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaaggctgtgtgcagctgctagctttgcctctttcctggaagaccaggatgggcacagtgccaactctcagtcctgcaagcctagaccagcagccatcagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451666 - DNA, 3169 bp, Homo sapiens
acgagctcggcctcggcggggattctcttgaggccatgcccgtgccggccgccagaggtcgcccgaggatcacgaatgggcccgaggagctggctgccccttcccccgcggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451667 - DNA, 3660 bp, Homo sapiens
gctacaagatgaccactgaggattacaagaagctgtgagtatgcaacgccaggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggcagtcctacccaggagacacaggcaccgtttatcgcgaagagggtggaggtggtggaagaggacgggccttctgagaagagccaggacccacctgctctggcaagatccactcctggctcaaacaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatc

SEQ ID NO: 451668 - DNA, 300 bp, Homo sapiens
cagtggcaatttttgaattataggaacttaccttttcctatacatccttgaaaccacaagggtaatgataataaacactcagataatgaggggctctcaaatattacagagtgtctttaaggctcagctggaaaacaagaaagtgctctttgaagtgggaaagccatctagaataccctggggaatgatgggactgacctaacctgaaggtcagcatcaggccagcaacgaggaacacaggaggcagaaatcacaactggattggactacagcacaaaataaacaatgaccaaatggcct

SEQ ID NO: 451669 - DNA, 305 bp, Homo sapiens
agtttgattcacatggactgtcaagtgtgtgaggctcagtatacatgtgcagcaacctcttcgggatgtttgaatgtgcaggattatctgaagaaacgtttgattgacttgaaagcccatttaatgataggacatggtgccgagtgtcagagtcctgtgttaattttggatgcgcagggtcttgctgtgctccaggggagctcctttctgtccagaggacagcaagtaaaacttgaaccagagatgcccctgtgcccactcagggcacccaagatctcagcctcttcaagaacttatcagaaaat

SEQ ID NO: 451670 - DNA, 5307 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagatttaagttctcaaaggtggctgcaccaaatcccatcccaagtgcccttcttccagtgtgaagggcactccttccacgaagagggaaagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaa

SEQ ID NO: 451671 - DNA, 5327 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagatttaagttctcaaaggtggctgcaccaaatcccatcccaagtgcccttcttccagtgtgaagggcactccttccacgaagagggaaagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaaaaattaacatccaaaaaaat

SEQ ID NO: 451672 - DNA, 5362 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagatttaagttctcaaaggtggctgcaccaaatcccatcccaagtgcccttcttccagtgtgaagggcactccttccacgaagagggaaagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaacacacaacaaggggtccagagcaaaaataaggaaaacagggccaaaaaggaaccg

SEQ ID NO: 451673 - DNA, 5137 bp, Homo sapiens
ctcggccgctcctccagctcccaggccccctccctactcgacggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaa

SEQ ID NO: 451674 - DNA, 4086 bp, Homo sapiens
ccccctagagggtttcagtgtccgctgcaatgtcccctgctattttgctgacacctaaagcagtcgtgtccttcctcaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaa

SEQ ID NO: 451675 - DNA, 3950 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcttcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaa

SEQ ID NO: 451676 - DNA, 1160 bp, Homo sapiens
gagagagagagagagagagagagagagagagagagagagagagagagagagagagagagagagagagagagaagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaa

SEQ ID NO: 451677 - DNA, 4233 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttccgcatcttgctcccatcagtcttgactgtgttaatgtatagaaatccctgttctttctatgccaccctagcgtcgattatctgatgggacgaagggtaccgag

SEQ ID NO: 451678 - DNA, 3966 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgggagcaagactggccagtttgcgtcacatcagttggggattttatttctgttagcagaaaaatagaattttgtgtgtgtcatagttgagttctcacgagatctgatgggagaagatg

SEQ ID NO: 451679 - DNA, 1223 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaaggtgagttagtctctccctcacgattctccttctcataccctttctcttgcagctgtttctgagaacttgtctgaacttagaagggtgaacaaaaaggaatacagaatagtccttgtatgtaaagaccaacttctgctaaaagtccctgatgtgcaggcaagaaaacaacttgtatttatttttacatggtgcttcctcatccctggaggtttcctgctcctacccatgttattctcctttaatctctgatgtcattgtgttgccttttgtaatacttactgcagccatcctcatacatcagtaattatatatttgactcatctttccctgccccgctagcctgctgggacttgagggca

SEQ ID NO: 451680 - DNA, 487 bp, Homo sapiens
gcgagctcggtaccggagacacttacgcgagacatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctctcatctttgttgatgacgtaagtgtctccgggccgagctgga

SEQ ID NO: 451681 - DNA, 5674 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagatttaagttctcaaaggtggctgcaccaaatcccatcccaagtgcccttcttccagtgtgaagggcactccttccacgaagagggaaagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaaaaaaaaaaaaaaaaaaaaaaaaaaaaaaaaaaaaaaaaagaaaaaaaaaaaaaaaaaaaaaaaaaaaaaaaaaaaaaccccttgtggcccgcttggcccaatccatttttagattggagaaggtttttccttgcggccgaatttggggctaatttgcccattcccccttatggggggtgaattaacattcaatggcccgcggtttaaaacggtggggccttggaaaaaccttggggtacccaatttaaatcgctttgaaaaacatccccttttgcaagttggggatatagcaaaggcccccccagatcgccttcccaacatttgcacaccttgatgtggaatgaaaattgaacctttaattttttgt

SEQ ID NO: 451682 - DNA, 5218 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaa

SEQ ID NO: 451683 - DNA, 4616 bp, Homo sapiens
gcgagctcggtaccggagacacttacgcgagacatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaa

SEQ ID NO: 451684 - DNA, 4930 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgtgtgtgttgtcaaggggaccctccgtggcctcccgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcgctgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtagtgaatctctcagccaaggagggaaagaaaaggaagaactcttgactatttagattctagttaaatatctggaatcctagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggtgatagatggatatagaagcatttctctgcaggataccagttcaggccccaccattcctgccaaggccattacatcccacaaacccaaatacaaagcagctgacttccctggatcttccccccactcctcacacctcacatgtcccaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattctttttttctaccaactctccagagcgtgagtataggagtgccatgagctttttagtcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaagggggggggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccctttgtgtatcttttcagactggggtgggggctgagcatgcttgtgcagaaagaagccatagccagaaaggacagaatctctcccccactcccttgccccataaccaaacataagctagctagtcttgtctaatagatgggatttactataggtgaagatagccctcatattcaaggacagaagctctggcaggagtaaattagcaaagcagaaatagtaccctttcattcttggaggtgctttgaaattttaggtagaatataatcgaaattatggaggttccttagtgctcaataatataagacctggtgttattagaacgagtctttcttataaactaacagagcaggtatatgcctgttagaccttagctgtggggttcctttactattgggtgaatcattaggtataaaaaataatcatcaaccaggcaaattactttgcttcctagctgatgtcatcccacattggtacaggtgttattcagtactgggtggttcagcagggaagccgggtgggaccagtgtgtctgtcatgaaaccactaactgcattcctgactgaagagccatctgtcatttattggggaaggtcttcagttgagctctcagccttaggaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccagtgtgagctcgcctatttctgcctaatcatgtacattatccaccaaaaatag

SEQ ID NO: 451685 - DNA, 2221 bp, Homo sapiens
cgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaattaaaaattaacatccaaaaaaat

SEQ ID NO: 451686 - DNA, 150 bp, Homo sapiens
tatacttttgcgagaagacgacagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451687 - DNA, 940 bp, Homo sapiens
tgagactgcgcatcgtcactcgctgtaccagtatcgagcctgcttgatctagagtggcttatcaagcggtctggctattgtgactcgtatcccatatgatcagtcctgtcctgctgcctgcttgcttcagcacggaggaccactacagtgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacaagcacgtgttgttccgatccctgcactgtggcccagacctgtgtgttgcctgatccgagtaggtctctcaagggaccgaccacggctctccctaagtgctggcccctgggtgtcactgcctcggcgcgcccgcgcacctgccgccaggggcgggggccacagtagtgtggggccatcgtcgggtttcacagctacccccgctg

SEQ ID NO: 451688 - DNA, 687 bp, Homo sapiens
catgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggcttcctgctgtgaagacagggtgcactgctgtccgcacggtgccttctgcgacctggttcacacccgctgcatcacacccacgggcacccaccccctggcatggccagcagccaagggggaccagccctcctccagcctgttcctgctgatgtggtcagcagccagggggtaccatccatcctccagccagctcctgctgaggtgatcagcagtcaagcgacaccacccctgctccagcctgctccgcaactgtctgttgacctgacagaagtggaggtcttgggagaagacaatgtggagaacatcaatccaaggacttcagaacaacataggcagggatctgatggtaatcacaccatcccagcatcttcgttgcattcaatgaccaacttcatcagcggactgcagagacttcatggcatgctggattcctgagaccttcatcttc

SEQ ID NO: 451689 - DNA, 153 bp, Homo sapiens
cggacgcgtgggtcgacccacgcgtccccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451690 - DNA, 2334 bp, Homo sapiens
catgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451691 - DNA, 849 bp, Homo sapiens
acaatcccacacaacactagagggcaacatggtggagagcgcgcttatcggacagcgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451692 - DNA, 2144 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451693 - DNA, 1680 bp, Homo sapiens
tcgaactgactatcagggcactggatggcacccacggagttgttacctgatctttggaagcaggatctcccgtctgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451694 - DNA, 2553 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451695 - DNA, 1279 bp, Homo sapiens
ctgtcctctctgctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451696 - DNA, 1954 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451697 - DNA, 2233 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccaggtcagtgccaacccccatcctggggctgggtatggccagggaccaggtcccacctcgtccaaccctctcgcccccctctgaccatccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451698 - DNA, 2222 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagtacctcacccgtagctgtacctcaccgtagctgtacctcacccgtagctgtacctcacccgtagctgtacctcacccgtagctgtacctcacccgtagctgtacctcacaccgtagatcgtacctcacccgtagctgtacctcacccgtagcatgtacctcaccacgtagctgtacctcacccgtagctgtacctcacccgtac

SEQ ID NO: 451699 - DNA, 1679 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451700 - DNA, 1545 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtaggggtttgccaggctcgaaccgccacagtcggcggggcttgaagtggaatacagtataaccacacgcgcggcgtgaacacgcgtgggttaatactaatcagcgtcac

SEQ ID NO: 451701 - DNA, 1286 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagagctgtctgctacaccgacaacctggtgcgagtgtggcaggtgaacatagacaca

SEQ ID NO: 451702 - DNA, 1329 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagccccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451703 - DNA, 1134 bp, Homo sapiens
  misc_feature (1032)..(1032): n is a, c, g, or t
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgcctgggtaaaaggccncgatcccaaggcccaactccccgaaccactcagggtcctgtggacagctcacctagtggcaatggctccaggctcccggacgtccctgctcctggcttttgc

SEQ ID NO: 451704 - DNA, 1690 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacggccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaaaaaaaaaaaaaaaaaaaaaaaaaaaaaaaaaaaaaaaaaaaaaaaaaaaaaaaaaaaaaaaaaaaaaaagaagagagacagacacacgcaggacgaagaaagaaaatcacaacaaaaacacaacacaaggagaggaggagagcggagcacacccatggttggtcgggcacgacaacggcggcaccacgggtgtttccctgaaggaaacatcgtgcggggaagagaagcaggggcgggggggatccaccgacaaaaaaaaaacgccgcccgcggtggacacaacacagcggctgtgtggagacaaaaatcctcggaggaggtgctcgcgggaagtcataacgacggggtgatcttaagcagagggacccacggaaagaccacaagaacagaaattgaccccacggagaggggaccga

SEQ ID NO: 451705 - DNA, 951 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacaagccactggtgttcgatcactgactggtgcccaagacatggtggactgatcagataatgcttcaagaaacgtacaggactctcataagtgctggcacgcgggggtcgagtgctgggggtccgcgtggacgcgcgcagggccgggtggcacagttgttgcacccggccggtctgccagtgtagcaccga

SEQ ID NO: 451706 - DNA, 836 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgaaggctggtgttggacggcagcattgagtttcctgccgtgccctgcctgagctctcagggccctgctcacctgctctggctgtgtaaccacctgggcttcatcataagcagcctgcgggtctctgtgcgcccgtgagaatatcgagaggagaccaacatctggttgaagcccagtttctcctgctgtgagaacaagtggatgtccctctccccgccctcctgctgaagtggccttgctgctctcaggcccggccactgggctccaagacctcgcaaggtttttccagtcaaggactttgatgacgacgggcaagctgaaacagcagcccttacagatagactcctcgcactctacccccaaattttgtttgacagtgtgcacacgtgcactggcattgtg

SEQ ID NO: 451707 - DNA, 1141 bp, Homo sapiens
catgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacaagccactggtgttcgatcactgactggtgcccaagacatggtggactgatcagataatgcttcaagaaacgtacaggactctcataagtgctggcacgcgggggtcgagtgctgggggtccgcgtggacgcgcgcagggccgggtggcacagttgttgcacccggccggtctgccagtgtagcaccga

SEQ ID NO: 451708 - DNA, 1014 bp, Homo sapiens
  misc_feature (845)..(845): n is a, c, g, or t
  misc_feature (903)..(903): n is a, c, g, or t
catgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagatnggccttgtccagctcgggtcatgttgtcccggacgcaacggtccccgggtggcccctngaatggggttcctaacctggcctgttgaagcttgaacccaggtgggggaacgttactgcgctgcttggccccaaattgcgcacaaacgggcccaacccttgctttgctccg

SEQ ID NO: 451709 - DNA, 1869 bp, Homo sapiens
catgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451710 - DNA, 475 bp, Homo sapiens
  misc_feature (423)..(423): n is a, c, g, or t
tacccttctgcgtgtcacacgtaaaccccgcgggacagcagtgtatgtggtctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccattgcgaggatcgcagcacntgctgccccggctggcgtacactacccaaccgatgaatagtggcgagcagta

SEQ ID NO: 451711 - DNA, 2618 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtgcagctggggtgtgggtgcagggcaggcagacgggcagcatgtggagtctggaacccaggagcccagctggcgggggcagccctgattcctgcccttgtgccctcattcatgtggcatctgtactaagcaacagccctgctgtggacagaggggcagcactggggataggagggtgcgggagaaagtgcaagactccaggtccaggcgttgtgggggtggggagaggtcgagctgggccggtctaataccaacccatggtcagtgggtgccccttccccatgccatcttgctgagggagggactggattgtgaggagggtgagttaggcctcctaggagatcactgagccttagtgtcaccctcaaaccccagtagctgggcttgcaggcctggtgccaccagctccttgtgtgatgggggagtcaccttccctgagtgggctggtagtatcctgggtcatcttgtccacaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451712 - DNA, 1884 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451713 - DNA, 2202 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaaaaaaaaaaaagagcggcaaaaaaaaaagtccgtatcgatgtcgagccgacatggatga

SEQ ID NO: 451714 - DNA, 2560 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaaaaaaaaaaaaaaaaaaaaaaaaaaaaaaaaaaaaaaaaaaaaaaaaaaaaaaaaaaaaaaaaaaaaaaagaagagagacagacacacgcaggacgaagaaagaaaatcacaacaaaaacacaacacaaggagaggaggagagcggagcacacccatggttggtcgggcacgacaacggcggcaccacgggtgtttccctgaaggaaacatcgtgcggggaagagaagcaggggcgggggggatccaccgacaaaaaaaaaacgccgcccgcggtggacacaacacagcggctgtgtggagacaaaaatcctcggaggaggtgctcgcgggaagtcataacgacggggtgatcttaagcagagggacccacggaaagaccacaagaacagaaattgaccccacggagaggggaccga

SEQ ID NO: 451715 - DNA, 2187 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagggtggccaccggcaggttgtactggagatgtatttgagaaccaagattataggtaaattttcaccagtacttagttctatttgcacactgaaaaatgtagtaggctgaatataatataaccaccactagtgaacattatatctcttagaagaaagcccatattttgctc

SEQ ID NO: 451716 - DNA, 2326 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaaaaaaaaaaaaaaaaaaaaaaaaaaaaaaaaaaaaaaaaaaaaaaaaaaaaaaaaaaaaaaaaaaaaaaagaagagagacagacacacgcaggacgaagaaagaaaatcacaacaaaaacacaacacaaggagaggaggagagcggagcacacccatggttggtcgggcacgacaacggcggcaccacgggtgtttccctgaaggaaacatcgtgcggggaagagaagcaggggcgggggggatccaccgacaaaaaaaaaacgccgcccgcggtggacacaacacagcggctgtgtggagacaaaaatcctcggaggaggtgctcgcgggaagtcataacgacggggtgatcttaagcagagggacccacggaaagaccacaagaacagaaattgaccccacggagaggggaccga

SEQ ID NO: 451717 - DNA, 1447 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagagaaaggtgtttgtgttcgacaccaggtggggcccagggtaacgttttactaagggaggcaaggaacgaaacggctgaggaaaaacgcgcccgggttctatccccccaaactgggccacctgcgggggaccctccccgggaggggaccctgggaaccacgggcacgaggccaaagccccccggtaggacacccccgggcccgccgccgggcccgcg

SEQ ID NO: 451718 - DNA, 1274 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacggccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaa

SEQ ID NO: 451719 - DNA, 1128 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggacaggaggcggaagcggaggcagggccagcggaggagaggtgagaagtgagagcccaggagtctttcatcagggggcctgaggggaagggacctgggaagccttcaggcagctgctttttctaaa

SEQ ID NO: 451720 - DNA, 809 bp, Homo sapiens
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacaagccctgtgtcgacactgtgtgcccagaatggttgccggccatatg

SEQ ID NO: 451721 - DNA, 2183 bp, Homo sapiens
  misc_feature (234)..(234): n is a, c, g, or t
  misc_feature (459)..(459): n is a, c, g, or t
  misc_feature (1249)..(1249): n is a, c, g, or t
  misc_feature (1287)..(1287): n is a, c, g, or t
  misc_feature (1701)..(1701): n is a, c, g, or t
  misc_feature (1732)..(1732): n is a, c, g, or t
aaggctgggtttagaatcggccgaggggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctgtgagtgccctcagcctaggcaagagctggcagctgggttttnccaaagggtcatcttggattggccagaggaggacgccaggcacaagtctgtggtttatcattttccctgtctttctaggacaaatggcccacaacactgagcaggcatctgggtggcccctgccaggttgatgcccactgctctgccggccactcctgcatctttaccgtctcagggacttccagttgctgccccttcccagaggtgagcgtgccatcagcccantggaggggcttaggtctgcatttatgcttttcctgcactctaccacctgcagataaaagggccctgccaatgcaggtttctctgtgttccacaggccgtggcatgcggggatggccatcactgctgcccacggggcttccactgcagtgcagacgggcgatcctgcttccaaagatcaggtgcagctggggtgtgggtgcagggcaggcagacgggcagcatgtggagtctggaacccaggagcccagctggcgggggcagccctgattcctgcccttgtgccctcattcatgtggcatctgtactaagcaacagccctgctgtggacagaggggcagcactggggataggagggtgcgggagaaagtgcaagactccaggtccaggcgttgtgggggtggggagaggtcgagctgggccggtctaataccaacccatggtcagtgggtgccccttccccatgccatcttgctgagggagggactggattgtgaggagggtgagttaggcctcctaggagatcactgagccttagtgtcaccctcaaaccccagtagctgggcttgcaggcctggtgccaccagctccttgtgtgatgggggagtcaccttccctgagtgggctggtagtatcctgggtcatcttgtccacaggtaacaactccgtgggtgccatccagtgccctgatagtcagttcgaatgcccggacttctccacgtgctgtgttatggtcgatggctcctgggggtgctgccccatgccccaggtacaaatctgggggagatggggntatgtggagggaagtgggggcagagttgggggccaggncagggggtgaagacggagtcaggaccattttttctcaggcttcctgctgtgaagacagggtgcactgctgtccgcacggtgccttctgcgacctggttcacacccgctgcatcacacccacgggcacccaccccctggcaaagaagctccctgcccagaggactaacagggcagggtgaggaggtgggagagcatcaggccaggggctggggcgggcctcattgactccaagtgtaggaaaaagtttcctccatcctggctgcccctcacgtttgctcctcttccagtggccttgtccagctcggtcatgtgtccggacgcacggtcccggtgccctgatggttctacctgctgtgagctgcccagtgggaagtatggctgctgcccaatgcccaaccgtgagtgagggctganccagcttggctgtgtgcccccagccacctgnccctgacacgcaccttacaggggctctgtggcatggggctggctggctgcttgctgggagcctggctgatgcagggttcatgctaccccctagtgggggattggggcagtgccagccatcagcctggctgctccctgtgtgctactgagcctggaagtgacaaagacccacccctgtccccactcagccacctgctgctccgatcacctgcactgctgcccccaagacactgtgtgtgacctgatccagagtaagtgcctctccaaggagaacgctaccacggacctcctcactaagctgcctgcgcacacaggtaccagaggcagggtgcagatacaggggtggggccccctttcctcccttttaggcctggccttaggatcactgcaaggtggtgtaagcggtaccctccatcttcaacacctggttccagctgtggagccggcaaagg

SEQ ID NO: 451722 - DNA, 513 bp, Homo sapiens
cggacgcgtgggtcgcccacgcgtccgtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451723 - DNA, 281 bp, Homo sapiens
cggacgcgtgggtcgcccacgcgtccggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtcctt

SEQ ID NO: 451724 - DNA, 178 bp, Homo sapiens
tttggttctgtatgacttttagaaaagttttttctaattctgtgaaaactcggaattccgctttgttgcagagctgaagggtttggatccagctcgagtcaacgtccctgtcattggtggccatgctgggaagaccatcatccccctgatctctcaggtacacgcatatgaccctgtg

SEQ ID NO: 451725 - DNA, 2261 bp, Homo sapiens
  misc_feature (2221)..(2221): n is a, c, g, or t
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacctcgcctttaaatggccaggcgtnaaaaataaggcgagaaaaaggaactgccttgccccacttg

SEQ ID NO: 451726 - DNA, 2197 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcatgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451727 - DNA, 2233 bp, Homo sapiens
  misc_feature (14)..(14): n is a, c, g, or t
aaggctaggtacgngcgggtgtgaatcggccgaggtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451728 - DNA, 1317 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtcctt

SEQ ID NO: 451729 - DNA, 1984 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttaaaaaaaaaaaaaaaaaaaaaaaaaaaaaaaaaaaaaaaaaaaaaaaaaaaaagaggggcgcgcgcgcccccgagaagaatatcccccgcggggggcgccccaaacttacagcggcgcccccgcgctttctgttgtgatgtacaagaggggggcgccccaccaatatagagaggagagcgcgctattataaagcgcacgcgagacgaacagcggggcgcgcgcggcgttatatacacacagacggggcgcgatcagtgtgggagacacagcggtggacacagggggagaaacactctggcgggaggaaagagcgacacccctattctatatatcgttggggggggagcgagagagcgcacaacaatatatgtggggagaagagatatccacatcacagtcgggcggaggattttttataggcgcgtccttaaggggggggatcaacatcttttatacacaatatttgtatagagacgcggggtgatataaatacggggggtgggtaaaacaatacgcgacgggcggcgacgaaatatttggggtctgggggagcggtgtagaagacaaagtgtttgacgcggagaaaatagaggggagatgctactgtcttagttggagagcaaatgtttttatatcaacgaggggcgatcctaagtgaggaaaaag

SEQ ID NO: 451730 - DNA, 2160 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgagctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451731 - DNA, 1550 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttaaaaaaaaaatcaacctccacccaaaactacccccacctatcctttctcctcacttctctcatgatcactccttttcctaacctttctctctctacttcctcacttgatcaaaaaaaaaaattccttttgcccaaattgcgagggccccgtttttgccccacggcaaaacttaacccagggctttaaagtcgggccgccttctctaaatgtccccccgttaatgtgccctttt

SEQ ID NO: 451732 - DNA, 2193 bp, Homo sapiens
  misc_feature (14)..(14): n is a, c, g, or t
aaggctaggtacgngcgggtgtgaatcggccgagggtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451733 - DNA, 2201 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451734 - DNA, 1274 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggggactgtcatgtgtacaagccaacgcaagatcactggtgaactagagactttgccttgggattgagtagtagtatgtaggctataataca

SEQ ID NO: 451735 - DNA, 2136 bp, Homo sapiens
ccatgttcatgccactgccattaaaggagctgttcatgccactgccattaaaggagctgttcatgccactgccattaaaggagctgttcatgccactgccattaaaaacagctcctttaatggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451736 - DNA, 2316 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggtactgggcgcgctgaccctggagacttgcttcctgtccccagtaggccaggattcgagttttgagctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451737 - DNA, 2082 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451738 - DNA, 2193 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451739 - DNA, 1470 bp, Homo sapiens
tgtcttggctggcggggccggctcacctgggcgtcacgtttgtggcaccagccaggctgacctgtctgtgcccccctaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451740 - DNA, 613 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccattccccacatcataggcgaaaaccatgtcccggatatg

SEQ ID NO: 451741 - DNA, 1252 bp, Homo sapiens
aaagaatatggaggttccaggctaggggtcaaatcggagctgcagctgccagcctaagtcagagccacagcaacgcgggacccgagccacgtctgcaacctacaccacagctcatggcaatgccggatcacacgggctcccggagcccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451742 - DNA, 1379 bp, Homo sapiens
tgtcttggctggcggggccggctcacctgggcgtcacgtttgtggcaccagccaggctgacctgtctgtgcccccctaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgagctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451743 - DNA, 641 bp, Homo sapiens
  misc_feature (14)..(14): n is a, c, g, or t
aaggctaggtacgngcgggtgtgaatcggccgaggtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagcgttccattgctttgacgtagctaatctccttgcagcatccgtgtgagttgtgcgtgaataaaagaaatcgtatacttcctaattccatagtatggacaaaccgaggctagagaactgggccagggttacagtcatttggccagaggattagaattcagcgcttctgacctgaagacggcttcctcttaacctttttggaggatctctcctgctgtgggcggactgagcctgccgccaggtgtcttaacagtgcttgacttggcccgcgaccacttaagcctaggagcctaggctatttttagccatcttctagaatggtggttcttaaactctgcagtgtgtcagaatcaccagaaagctaataaaaaacagacgtctgggttcattgaagaagcttaagactgcgggggggggggtccgcatttttaccaggtgaatctaattaaacctaattttgagaaccca

SEQ ID NO: 451744 - DNA, 927 bp, Homo sapiens
  misc_feature (14)..(14): n is a, c, g, or t
aaggctaggtacgngcgggtgtgaatcggccgaggtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagcgttccattgctttgacgtagctaatctccttgcagcatccgtgtgagttgtgcgtgaataaaagaaatcgtatacttcctaattccatagtatggacaaaccgaggctagagaactgggccagggttacagtcatttggccagaggattagaattcagcgcttctgacctgaagacggcttcctcttaacctttttggaggatctctcctgctgtgggcggactgagcctgccgccaggtgtcttaacagtgcttgacttggcccgcgaccacttaagcctaggagcctaggctatttttagccatcttctagaatggtggttcttaaactctgcagtgtgtcagaatcaccagaaagctaataaaaaacagacgtctgggttcattgaagaagcttaagactgcgggggggggggtccgcatttttaccaggtgaatctaattaaacctaattttgagaacccaagaggtgctcgcatgccttttaattacgacgcccaagagggaggtaattttaaaggggaatccaaatttatcatcgaagttctcgagtttcctgtacatccagttcatttgaaaaataaatacaaatgctcctggattgatggctacttcccatacccatcgcaagttgttaatatcctgagtcaaaaggcgagtttaactttgtgtattttcaacttgcaatgggttcccacaggcaaccccattgtaagttgaatgtaccaaatgcttttgcgcaggtgaaatg

SEQ ID NO: 451745 - DNA, 272 bp, Homo sapiens
  misc_feature (14)..(14): n is a, c, g, or t
aaggctaggtacgngcgggtgtgaatcggccgaggtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccaggtggaggttgcagtgagccaagatcacaccactgcactccagcctgggtgacagagcaagactccctctcaaaaaaaaaaaaaaggagttttcatca

SEQ ID NO: 451746 - DNA, 345 bp, Homo sapiens
cggacgcgtgggtcgagaagatgagctcggggatggcatccgagatcatcttctcctcaaaagaggagactttgccgatgcccaggttctggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtcctt

SEQ ID NO: 451747 - DNA, 2251 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451748 - DNA, 1563 bp, Homo sapiens
  misc_feature (1454)..(1454): n is a, c, g, or t
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaataaaaaaaaaaaaaaaaaaaaaaaaaaaaaaaaaaaaaaaaaaaaaaaaaaaaaaaaacaaaaaaaaaaaaaaaaacaaaaaaaaaaaaaaaaaaaaaaacaaaaanaaaagaaaacaaagcgagacgagggcacggcgcacgcacatagcaacccccgcgagcggcgacgaaaaaatacgcccaccccaccacattcgaagcacggggcaacgaa

SEQ ID NO: 451749 - DNA, 2220 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451750 - DNA, 1678 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttaaaaaaaaaaaaaaaaaaaaaaaaaaaaaaaaaaaaaaaaaaaaaaaaaaaaaggggggggggcgagaaaattcccccgggggggccaaattaggggcccagttgtgtggaccacaaagggggcccccataaggagaggaccgatcataaacagaacgtcgggcacggggggcggcacggttaaaaaaaaaagcctgccgaacggggacaaaaccagcgccatcgccgagggacacattggagagaaaagaaaccccaaacctggcggcgacgagccacatcctgggggcccaaaccatccccgcacagaagttacagagcccacggaacaatagacaacttcagggcacaacggggaacc

SEQ ID NO: 451751 - DNA, 2191 bp, Homo sapiens
  misc_feature (31)..(32): n is a, c, g, or t
ggcaattactccgattcagaacccacgcgtnnggtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451752 - DNA, 1270 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcacatcatcatgccttccaaattgtgggtggctctgtgggcgcatcaataaaagccgtcctt

SEQ ID NO: 451753 - DNA, 2108 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttggggtacgtatccaggcgtgggtccttctgactgtggaataagggggcgttccctttgcttaagcctcaggagctctccctggccctttatgcagtaagctcatgtgcctgcctggcgagtgctgttgttttcaagggtggacgcacacccgagaaaaaagagctgggaggatcacagactgtgaagggtgaacctcccagcaagtgggtctccttccctgcagtttgacagcgggtgcccagcagctgcaggagtattgactgataagacactccatctccaggcagcccagggaggcctccctaccccgcctgaacacctccctgtcgctccttgttcatcttgttctgactgcggggggcggccaggcccaattcctcttcgagagtgtgccccatccagacagcctgagtcttcagcaaacagaaacccttaggtcttactcataccccctcaagccgagtttccatttctcacctgtgggcagaaatgaggcagatgtgtggttgccttcatcacgtggccagaaagtaatatggctcactgggccaccccaggacctttctcagagatgctccgatacagaaagatccttcagctatggccccaggccttggtgagagacaggcactcgatggtatagttctgtccccatgtcggtgcaggtgtatggaatggcagggcctgcaggtgagacgcacccggttctcataggcccttgagccaggggaagcagtaggagggaattgagttgaggtgaggactgaggctgttgccacacaaactgtgctcagtttctgcaggtgagacggtggcagagatgcctgtttttgccaatgtcagacatttacctacttagtgacacctgattcaggtgactgtgacaatgttttcagtcctttaccaacctgcggggagagacaagaacccagaaacaggctctgttggggagaatacggtgaagtgttcctgatgattgagttcctggcgtccaggtgcttgtcgcattgtcctcgtgttcacgaaggtggatggtgcttgttttatagctaaggaaacacatttggaaggtcagtcattgtccagggtacctgccta

SEQ ID NO: 451754 - DNA, 2247 bp, Homo sapiens
  misc_feature (872)..(872): n is a, c, g, or t
  misc_feature (874)..(874): n is a, c, g, or t
  misc_feature (877)..(877): n is a, c, g, or t
  misc_feature (882)..(882): n is a, c, g, or t
  misc_feature (898)..(900): n is a, c, g, or t
  misc_feature (905)..(905): n is a, c, g, or t
  misc_feature (907)..(909): n is a, c, g, or t
  misc_feature (912)..(912): n is a, c, g, or t
  misc_feature (920)..(920): n is a, c, g, or t
  misc_feature (925)..(925): n is a, c, g, or t
  misc_feature (935)..(935): n is a, c, g, or t
  misc_feature (937)..(937): n is a, c, g, or t
  misc_feature (940)..(940): n is a, c, g, or t
  misc_feature (948)..(949): n is a, c, g, or t
  misc_feature (953)..(953): n is a, c, g, or t
  misc_feature (958)..(958): n is a, c, g, or t
  misc_feature (962)..(962): n is a, c, g, or t
  misc_feature (965)..(965): n is a, c, g, or t
  misc_feature (985)..(985): n is a, c, g, or t
  misc_feature (1007)..(1008): n is a, c, g, or t
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcagaaacaaccaacnanaanaaagnaaaaccaacccccccnnncaccncnnnacngaaccaancaaangaaaggaagncnccncggaacgnnccgncgggnaganacnggaaacggaagggaccgacngccccacaccgctgcagcttgnnaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacagcccaaaccccagccgctgtgtcaaggcctaggacgccatgctgccatcaaaagggggttccaggtttccatcagtggcctaaagaagggacttcttgttgtactgaggagtgcggaattaaagagatttgactccctttagtattgggggcagtccgttccccagacactgtggcctctgaagtggaaactgaaagctgcatacctgggaaagaactttctaggaataggcaatggccttcagtggaagagggagggctggaggtgtgcccagtacttggatgttcatctgtccacaacagctttttgtttttttaaaaaagctaaaatggaaatggattttatcataaaggatgacatcgttttcttctacaattaatacatgttcattgtataaaacccaaaaagcagctaaaaaataaagcgggaaaggaactactggtaaaaaaaaaac

SEQ ID NO: 451755 - DNA, 1256 bp, Homo sapiens
  misc_feature (863)..(863): n is a, c, g, or t
  misc_feature (874)..(874): n is a, c, g, or t
  misc_feature (876)..(876): n is a, c, g, or t
  misc_feature (895)..(895): n is a, c, g, or t
  misc_feature (899)..(900): n is a, c, g, or t
  misc_feature (925)..(925): n is a, c, g, or t
  misc_feature (929)..(929): n is a, c, g, or t
  misc_feature (936)..(936): n is a, c, g, or t
  misc_feature (969)..(969): n is a, c, g, or t
  misc_feature (993)..(993): n is a, c, g, or t
  misc_feature (995)..(995): n is a, c, g, or t
  misc_feature (1191)..(1191): n is a, c, g, or t
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcagcangctctgcaccntntcatggcgatgccgcgccngttnngctctccctgggatgcatgatgaanagangtgttgngatgtcctcgtagtcacagaacgatgtctactntcacacgtgtgctggaaaggctcnangactgcattgaaagtctcttgaggaataatcgatcatccactaagctatagaagggagatcgagactatgagcctacgtgcagtctatataagtatgcttgacctggtaactgttattgttgaagtacgtgaaagctcaagggggctggccatacgctaaaaaaaaacagggcgcatcctctggtatatacgtacntgaaaggctacttaacttcgtagaacgagccctccccgcgggggttgtttatttttattacgcaa

SEQ ID NO: 451756 - DNA, 625 bp, Homo sapiens
cgaccggaagtccggtcactctcgcgaggccccagagagcaggcgctgggcagtgtggaggtcgttggagtcacttccgcgtcaccagctcctgtgcctgccagtcggtgcccctcccgctccagccatgctctccgccctcgcccggcctgccagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggtaattcaccatccccataaaagagaggtttaagaggatgggggtcacccacaaaatttggggggaggg

SEQ ID NO: 451757 - DNA, 1418 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451758 - DNA, 723 bp, Homo sapiens
  misc_feature (32)..(32): n is a, c, g, or t
  misc_feature (66)..(66): n is a, c, g, or t
  misc_feature (71)..(71): n is a, c, g, or t
gtcatgttactattggtcttcaagtaatgagnccacacaaaaaagcttctcctaggtctaggcaanagaanaagcatttgcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451759 - DNA, 1602 bp, Homo sapiens
gcacatacccttaggcccacaagacttcacagggtatagaatgttgcaagggttttaattttcagatcctcatcttccaactctgcttgaaactaatttccctctgaacatgcgtgatgcctgccagttctcctttcattctccccattcatccaagtgaggagcccgtgacaagactctgagtttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagctgtgcatttggatcagctgctatttggcaatacgaatcactgaaatccaggggtccagagttattttgatggcataaaagctgattggttggatagcataagaccacaaaaagaaggagacttcagaaaggagattaacaagcggtggaataacctaagtgatggccagcggactcaggtatcatagctgcaaacgtccttgtattctgtttgtggagagtaccttctctgcagtggacagtgatctgatatttcaaatctaatccagcctcaaaagtccgttgttctccaatgttgctgtcaacattcaatcatttctccttatttcacatggcagcaaatatgtatgttttgtggagcttctccttcagtatagtgaacattctgggtcaagagcagttcatggcagtgtacctatctgcaggtgttatttccaattttgtcagttatgtgtgtaaagttgccacacgaagatatggaccatcacttggtgcatctcgcgccatcatgatgatcctcgcagctgtccgcactaagatcccagaagggaggcttgccattatttacttccaatgttcacattcacagcaggaaatgccctacaatccattaacgccacggatatggcaggaatgatcctgggacggaaattttttgattatgcagcacatcttgggggagctctctttggaatatggtatgttacttaccctcatgaactgatttggaagaacagggagcctctagtgaaaatctggcatgaaatgaggactaatgcccccccaaacaagaggtggctctaagtaaaactgggattgcacagtaccggtgcacctgtcttgtcctgccggagagccccaggagacatcggccctagagtgatcatggctacgttcccgcctggaagacgccagcatctggcctcccactgttttcagctgtgtccccgggtccgtgtcttttcagaaagtgaaaatgacatagttgtgacgtaaaggtttacatctagttcgtaaaaaataaaaaaataaaaat

SEQ ID NO: 451760 - DNA, 771 bp, Homo sapiens
gatcattagctggtttactgagctgtctttcatcatagattccaaattctgttggattctttcaactattgttaaccaataaattgtatgttgtggatagtcgatgaacttgaaataaaagatttctttttccttccagtttgttgtagcagtgttctggatcatttatgcctatgacagagagatgatatacccgaagctgctggataattttatcccagggtggctgaatcacggaatgtttaacctaaaaagggccacttcatttccttaggctgcacttctaatgaatgcagacatttgaaagggtcctgaaccggataacctttcgagttttctccagttttattattctgtgaagacagtttggtgtaaatgatttaagagcatttcaaagcttaaagttttcttggcacgcttttcaaacgcccatctgactttgaagcaggctgcctctccacagaaagcttgctccagcaatgactaaaggattgacctggtgccatgcatgctgctctgcacaagaaggacatttggaaatgaccttgaagcgaagttttgccaagttgatgaaatacgggccttcaagaagtgccatttctcaagcgatgtacagaagggtatccgcagcattgtcaaaaattaccccttaatttggtgttggatgaacatgaatttttaacctccataaggaatgatacttgctcttgattttattagttgcattttgtaacaggttggaaaaattaggtaatggagaactttggcata

SEQ ID NO: 451761 - DNA, 592 bp, Homo sapiens
ttagccctgaaacggagctgtacacgaaaacaggcctcttctctctccctcagaaaccaatccctttgcctgaaagaacaccattcggagatcagagagagaggagtttgttgtagcagtgttctggatcatttatgcctatgacagagagatgatatacccgaagctgctggataattttatcccagggtggctgaatcacggaatgcatttcaaagcttaaagttttcttggcacgcttttcaaacgcccatctgactttgaagcaggctgcctctccacagaaagcttgctccagcaatgactaaaggattgacctggtgccatgcatgctgctctgcacaagaaggacatttggaaatgaccttgaagcgaagttttgccaagttgatgaaatacgggccttcaagaagtgccatttctcaagcgatgtacagaagggtatccgcagcattgtcaaaaattaccccttaatttggtgttggatgaacatgaatttttaacctccataaggaatgatacttgctcttgattttattagttgcattttgtaacaggttggaaaaattaggtaatggagaactttggcata

SEQ ID NO: 451762 - DNA, 1570 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaaacaataaaaaaaatcggcctcgtttggcctccaccggggaacctctgcaggcggtttccctttagggaggggtatatcatgaaccttggtacattgtttggtgaacctcggtctttcgggtgggacaacggattcagccactccaagggcgc

SEQ ID NO: 451763 - DNA, 1566 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaaaaaaaaaataaattggcctcgttgggctaagcgggtgaactttgcggccctttcctttaagggagggtaattcctgatactcgcctatggacttcttggcctcgggtgttcggttgggagcagcgttttaacttactcaaggggggat

SEQ ID NO: 451764 - DNA, 1458 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaacctgacgtctgcattgtggcatctcaaaatcctaacagca

SEQ ID NO: 451765 - DNA, 1259 bp, Homo sapiens
gcattgatttctctacggagtagcattcaaatatgtaactgatcatggactccaggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451766 - DNA, 1487 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaaatatgaaaattaagtttatgtacctaggaccatctagttagttccacaaagacagatgttttgtgccaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451767 - DNA, 1302 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451768 - DNA, 1351 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactcctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451769 - DNA, 1527 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaaatatgaaaattaagtttatgtacctaggaccatctagttagttccacaaagacagatgttttgtgccaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaacctgacgtctgcattgtggcatctcaaaatcctaacagca

SEQ ID NO: 451770 - DNA, 728 bp, Homo sapiens
ttaaacaaactgcttgtggtttaatctgatgctcaaataaaacactttgcctgtatttctaggtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451771 - DNA, 1789 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagctgtgcatttggatcagctgctatttggcaatacgaatcactgaaatccaggggtccagagttattttgatggcataaaagctgattggttggatagcataagaccacaaaaagaaggagacttcagaaaggagattaacaagcggtggaataacctaagtgatggccagcggactcaggtatcatagctgcaaacgtccttgtattctgtttgtggagagtaccttctctgcagtggacagtgatctgatatttcaaatctaatccagcctcaaaagtccgttgttctccaatgttgctgtcaacattcaatcatttctccttatttcacatggcagcaaatatgtatgttttgtggagcttctccttcagtatagtgaacattctgggtcaagagcagttcatggcagtgtacctatctgcaggtgttatttccaattttgtcagttatgtgtgtaaagttgccacacgaagatatggaccatcacttggtgcatctcgcgccatcatgatgatcctcgcagctgtccgcactaagatcccagaagggaggcttgccattatttacttccaatgttcacattcacagcaggaaatgccctacaatccattaacgccacggatatggcaggaatgatcctgggacggaaattttttgattatgcagcacatcttgggggagctctctttggaatatggtatgttacttaccctcatgaactgatttggaagaacagggagcctctagtgaaaatctggcatgaaatgaggactaatgcccccccaaacaagaggtggctctaagtaaaactgggattgcacagtaccggtgcacctgtcttgtcctgccggagagccccaggagacatcggccctagagtgatcatggctacgttcccgcctggaagacgccagcatctggcctcccactgttttcagctgtgtccccgggtccgtgtcttttcagaaagtgaaaatgacatagttgtgacgtaaaggtttacatctagttcgtaaaaaataaaaaaataaaaat

SEQ ID NO: 451772 - DNA, 845 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagaccctcttgctcccatcagacatggcaaggctattccatattcttttcttttcaggaaagctctgcccttctcatgatatcgccatagctaacataaggcttttctttctgagggacgaagtcgcg

SEQ ID NO: 451773 - DNA, 856 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcatttcaaagcttaaagttttcttggcacgcttttcaaacgcccatctgactttgaagcaggctgcctctccacagaaagcttgctccagcaatgactaaaggattgacctggtgccatgcatgctgctctgcacaagaaggacatttggaaatgaccttgaagcgaagttttgccaagttgatgaaatacgggccttcaagaagtgccatttctcaagcgatgtacagaagggtatccgcagcattgtcaaaaattaccccttaatttggtgttggatgaacatgaatttttaacctccataaggaatgatacttgctcttgattttattagttgcattttgtaacaggttggaaaaattaggtaatggagaactttggcata

SEQ ID NO: 451774 - DNA, 204 bp, Homo sapiens
cttatcaagtacattaattcattggctctggtaatatagctaattaccctgtatattcaggtgctgctgctgatattgctgctatctccatgtgctgggataaacagactgttgttagtaaacattccttctgatacctaccttccgccatcactacgcacgtactaatatgtcttttttgctctgttctttttcccacaacag

SEQ ID NO: 451775 - DNA, 1447 bp, Homo sapiens
  misc_feature (71)..(72): n is a, c, g, or t
actctgggtctgtgccatctttaagagctgtaacacttaccaccaaggtctgccgcttcattcttgaagtnnctgagaccactaatctaccggcaggacaccaattccagacacattattaaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451776 - DNA, 610 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctgtgattgcgtgtgaaggcctggctgcccccgcagcggcaccttctgaaccactcaccgttacctggtagctgggtacccttacctggcaactgggggacaaatggaggtggggcgcagccaggtggtgggctctttggagggggacaccgaactgcttctaagaggtgacacgggaagaatcttcaacaaaagcatcggacctgatcctgaatggcctgagacccattcgccctcaaggtgcttttcagagcacccaccgtgggatgaacttgttgcaactgaaggaaactgggtattgtctagtgatttggaacttcacctgaaagaaccaaatccttctcataagggagagaaagcacctaataaagttgtcttctttgcatctgtttttttccc

SEQ ID NO: 451777 - DNA, 1485 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaaaaaacgaaataaatagtaaaaactaataggttggaaatatatacacttcggcctcatcggcctcacc

SEQ ID NO: 451778 - DNA, 1482 bp, Homo sapiens
cgcccactagccacagggcccgcttccccctggagatcagcgcgcacttcccgagccctcgtagcactcagaggtcgcatccacacctgggatgcctagggggcgcctcctggccgggtgtcccgggaccctgcgaacgcaggagcagaatgacgaaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451779 - DNA, 1588 bp, Homo sapiens
  misc_feature (71)..(72): n is a, c, g, or t
actctgggtctgtgccatctttaagagctgtaacacttaccaccaaggtctgccgcttcattcttgaagtnnctgagaccactaatctaccggcaggacaccaattccagacacattattaaggtgctgcggatggcaatcctgctgtcttactgctctatcctgtgtaactacaaggccatcgaaatgccctcacaccagacctacggagggagctggaaattcctgacgttcattgatctgatggagtctcactctgtcaccaggctggagtgcagtggcacgatctcggctcactgcaacctctgcctcctgtgttcaagctattctcctgcctcagcctcccgagtagctgggactacaggcgtgtgccaccatgcccgggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451780 - DNA, 1262 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctgtttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451781 - DNA, 935 bp, Homo sapiens
  misc_feature (30)..(30): n is a, c, g, or t
  misc_feature (36)..(36): n is a, c, g, or t
gtgtaggttgatctcagaggaccccgcagnctgctnccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 451782 - DNA, 1541 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaaagcctccatcttggcaagatatgaaaattaagtttatgtacctaggaccatctagttagttccacaaagacagatgttttgtgccaagtaagtatcatcctcatttacaagaggggtcacaaactgctggcctcccccaacttctacctatcaagttctgttaggcctacatcgtggaatttttgtttttgaatcagtattttaaaattgggtgattttggctgggcgcagtggctcatgcctgtaatcccggcactttgggagactgaggcaggtggatcacgaggtcaagagatggagaccatcctggccaacatggtgaaatcccatctctactaaaaatacaaaaattagccaggcatggtggcgtgtgcctgtagtcccaggtactcgggaggctgaggcaggagaactgcttgaacccaggaggcagaggttgcagtgagctgagatcatgccactgcaccccagcctggcaacagaacaagactccatctcaaaaaaaaaaaaaaaaaaaataggagatttcacatgaaggccagattttcagcttcttaggaaatattttaagatctggaacacagagcccactgttctattctggtgacaatggtttagaatagagtatcagttatcccttggctgggcacggtggcttacacctgtaatctcagaactttgggaggctaaggtgggcagatcacttgagcccaggagttcaagaccagtctggccaacattgcaaaactccatctctactaaacatacaaaaatgagccgggcgtacat

SEQ ID NO: 451783 - DNA, 907 bp, Homo sapiens
cgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtaagtattgtctgagggaacataaaacaagagaattactgccggcaacggtctatgcagagactgagggaaaattccactgtagcctcttcttttagccttcacacaggatctcctataaagagctccatttttaaaactacaatatgatttta

SEQ ID NO: 451784 - DNA, 3370 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451785 - DNA, 2819 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaaggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacgggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451786 - DNA, 3408 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatggtaagcactgactttaaagtaacaggttatttcaatgtaggggattctttctttcttgaaccatgaatgttattttagctgaagaattcttggggttttataagggtccaccagtatgcatagtactttttcttctagatgctaaatcaatttgattaataaaagagtaggaatgtaaccacattggaaatatgaagtcatacttttttatgagttatttaattttttagtaaatttgttttagaatgggcagtgagttgaataatttgggatattttaaatgttattttcaaatttagtgaatttgagattctcaactctgttgtccatatgttaaaatatttaaaaatacctcagtgaagcacaaaattaataactgtgctcacattgaaaaaaatggcccaggcgcggcggcacatgcttgtaatatcagcacgttgggaagctgaggcgggtggatcatttgaggtcaggagttcaagaccagcctggccaacatggcgaaaccccatctctactaaaaatacaaaaattaacaaggcatggtggcgcgtgcctgtagtcccagctactcgagaggctgaggcaggagaatcacttgaacccgggaggcggaggtttcagtgagccaagatcacgccactgcactccagcctgggcaacagagggagactccatctcaaaaagaaaaaaagaaagaaaagaaaagaaaagaaaaaaaaggaattaaaacctagaccagtgagccacatcattagcattatttaagtggtttgagcactttagtagatgggaggggagcagggtgcctgtgggcgtactccccatactctgatttcagcagagtggggtagctggtaatacaaaagccttacattcctttctgtttctcacccttcttttcttaagtcaaacttcatgggagacagggaaggaatcaggggaagcttaatacttgacagtatcaacctag

SEQ ID NO: 451787 - DNA, 3443 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451788 - DNA, 4002 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgaggtaagaggaaaatggcggtgggtgtggattgcctttgtgtgagaaggacgagacggaaatcgaggaagcaaggcgttcccggggcgagggatcgggtgacgcgctccagctggcctcgaccaccgaaccccagcgatttcagggcctagagtccgtcgtcgcctgacaggtgtaccagaggcgcctggccgtggccggcctctatctcgggcccgcccagaattcccagacggtgcccggttgccaggctctgggctggagcggtgtctcttccttcctgggaatggatgtgcggcgggggggactgcgcccggctggggcggggccgaatcgtgccttttagatagtcacaacttagcctcctccttttccatccgcgatttttttggacattaaaactaccactactatggaagtaccactactagatggaagtttgacctggacatggtggctcacacttgtaatcccagcactttgagaggccaaggcagcagagcccttgctagaagccagtggcatgctcttgaacttcccagcctgcagaactatgagctaaaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451789 - DNA, 4746 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgtgtttcttcatatagctttaaaattatgctattgacattatgggaaagatttatcaatgagagaaatgtgtctctttttcaggtatgtgcttttgatatagtttacattggaaagggtcataatgctgttttagtttgtgaaaataagtaaaaagctgctgataccatagaatgcttttcccatgaaaaatttcagtacatcttccagagctgttttcatctctgcctacaggggtaaagtccgcatggaattagagggggaaagtctgcactggaacctgctgtggccattttttttctgttgttgctgcttctctagtggagttactgcagcttagggatggttcctggaagtggacacattttacaaaaacgttttttaaatacacgccagctcttcgagaagcacttttttccttccgtcatgcttcatactatattgtattgtactaacccctcatgctgggatgagcgactgcctagcaagcaacccactgcctactaacatcaagaggggctaaataaaactgcattttccttgcaaggacaacttctaccgtatgaatatatattatatttatgtattatattttgtacaatagttgatcttgaatgcagacttcatttgtatttttcgtggtactacaaaatgtgtagaagttatggcttttctttcattagggtcttgttaggtggttggcaagtaagttaaattgtatgttgcatttttttccatgctgttttaacttgtaaatatatatgtatacatgtggaagatattattattatctagattactttaagccttttatctgatgtattatcagtgaaaaccatgctgcttattccctaatacaatggttctcaaactttagtgtgtatcagaatcaagatgagggcttgtaaaatatagctggtccctactcccagagtttccatttcaggaggtctgggatcaggcccaagaatttgcatttttaacaaattcctaggtgataactgataatgttggttcagggaacacactttcagaaccactgctttaatattttaaataagataatatgtgaggtgtcataaaaaccttcatcaaatccctatctcatttcatttcttaggcattttctctcttataaagtttcctggatttataaattttcattgattttactagaaagttttatttagcttttatttatttattgttctttttaagaaaaaaactgagagtttgaattaaaagtttaaatcattgctaggtccttagttattttttttcttttttctttttttttatttgaagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451790 - DNA, 3317 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451791 - DNA, 3060 bp, Homo sapiens
ctctctcaaaaaataataataataataataataataataattcatgcttacccctttaccaagaattctgccttctccaccaagctgtcctctctactagtctctccttctccatgaatccttctctgagtgctccagctctgccgcctctcctaacactacagaccctcacactagaggaacattgtgataaaatataaaggaagtcttgaaccccaaagcatatagcagagaagggaaatgattaacagattgatttcctgcaatctgttcattcatatactgggcctacatacatcagagattaattttaggcactgttgttttctatatgttcagggttttgttttgttttgttttgtttgtctctgtaacaaaattacagtcttcttaaataggggccttattatcccacagcattcattcagcaaattactcattcaacaagtagttattaggtacttgttatatgtcaggcactgtttactgctgtatccctagcgcaaagatcaagagacaaaatgtaaagcctcctacctgcctcaaggcttaaattctaacacactcgtcaattgatcctctcattactcagattatatccaccccatttaattagtaataattgtgaactatcaaccaacttctaatatatgttgcttcctttaagagctaacagatttataaactaagaatgtacatatattgaaaatagcattgtatataaacttatatccttttttattgtttagtgtttcttcatatagctttaaaattatgctattgacattatgggaaagatttatcaatgagagaaatgtgtctctttttcaggtatgtgcttttgatatagtttacattggaaagggtcataatgctgttttagtttgtgaaaataagtaaaaagctgctgataccatagaatgcttttcccatgaaaaatttcagtacatcttccagagctgttttcatctctgcctacaggggtaaagtccgcatggaattagagggggaaagtctgcactggaacctgctgtggccattttttttctgttgttgctgcttctctagtggagttactgcagcttagggatggttcctggaagtggacacattttacaaaaacgttttttaaatacacgccagctcttcgagaagcacttttttccttccgtcatgcttcatactatattgtattgtactaacccctcatgctgggatgagcgactgcctagcaagcaacccactgcctactaacatcaagaggggctaaataaaactgcattttccttgcaaggacaacttctaccgtatgaatatatattatatttatgtattatattttgtacaatagttgatcttgaatgcagacttcatttgtatttttcgtggtactacaaaatgtgtagaagttatggcttttctttcattagggtcttgttaggtggttggcaagtaagttaaattgtatgttgcatttttttccatgctgttttaacttgtaaatatatatgtatacatgtggaagatattattattatctagattactttaagccttttatctgatgtattatcagtgaaaaccatgctgcttattccctaatacaatggttctcaaactttagtgtgtatcagaatcaagatgagggcttgtaaaatatagctggtccctactcccagagtttccatttcaggaggtctgggatcaggcccaagaatttgcatttttaacaaattcctaggtgataactgataatgttggttcagggaacacactttcagaaccactgctttaatattttaaataagataatatgtgaggtgtcataaaaaccttcatcaaatccctatctcatttcatttcttaggcattttctctcttataaagtttcctggatttataaattttcattgattttactagaaagttttatttagcttttatttatttattgttctttttaagaaaaaaactgagagtttgaattaaaagtttaaatcattgctaggtccttagttattttttttcttttttctttttttttatttgaagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451792 - DNA, 5120 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaattgatgtgtgctggggtttggaactaaaagtagtttcaacagtgcgtgggttatgacatttcttatgtttctttgttcatgtgtgtatttagtagttaattttaagatgtcctagtgatctttaaaagaaaaatattgtaccattttttagaattacactttcacctttctttttgcaattgaaagtgatgatgtcaaagtgggatttctgtactccaaggccccacccccaatttagcaagcagaaaaacgttccttgtatcactttaccttggataattgggtgccattaacacaaacaggtcacaatcctgctgttttctagccctgtccaccataatgagattcaggaaacatcctgtcagcctcctggaaagcatccttgtctccttagtatttcatttacaaactacctcttaacagagactgcttttcaaattggccaatcttacctgttttgtgttgtgattgcattttcaaagagtaattattttcagcatatacagttttgaaacctgtagctcctatgcaataacatagttctatagacattatttgggggaaatgtagtaataactcaatctatgttgctgtcctagaaaggaaattgcatgatgaatctagattgtctttagagtaaagaaacacattcaaattcctgtaacttatcactttcagtgagtaaatttacttataccaaaggggattttttttctttcaggaatctaaggaaatttactttttaacctgagaaaaaaacttggttctgctttatataaacagtagagattattgtactataagtgattttgcctttttgccaaaatcctggaactcatctataattaacctcttcggagcaataccttaggttgggccttgctttactacttagaaatagctaaatttcaattttaaaaatctttgtgtgttataactgttaaattattcaataatacttagggtttactttcttatttaaatcacttatttagtttaccgacttcatttttctttggatttagaagaagcaattatggaaaaacttggtaatctctctcaacctataaccttacacaggaagaattagagtttaataatttttaattcttttattgtatgttacttttattacaccagtttgggggaaaatcttcataaaattgtatcagttttattcagtgttctctaaggtgataccttttaattttgaaagactaaataattttaatcgagaatttccagtctttcagtctgatctatttaattcactacttgttacataatccagtgaaaactctacttgttgaaattatgacataaagatcttgcagctttatttgagtatttgttcttttgtgtagtttccatcttttaaaatatttaaaatattttcaagataaagtattatcttctctgcaaaaattcctggagtaattttctctcataatatttgaagtcagtggttctcagttgtattagtggggtaactacatcaaaataaataaagtcttatttttaaaatgcaaattttagaccatactcccagtgattcttagttggtctttttggaatgagccataggtaatgtttatgtccaataaaatctaggaacctctgtctggaactttgctcttcttgccatgaataccttaggaagtattaaaaaacaggccaatgtaatatgagtaggttttcttgtttgttacttttctaagaatattttacttcccttagcaggcttttggct

SEQ ID NO: 451793 - DNA, 1852 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451794 - DNA, 910 bp, Homo sapiens
  misc_feature (205)..(205): n is a, c, g, or t
  misc_feature (209)..(209): n is a, c, g, or t
cactattttatatatttaaaaaacacgcaaaagataactatctgaaaggcatgcgctacaataacgtgaaatacagaaacatgacgacagtgtcagggcagaaaatataaggtcctgcaaaactttctaaaacttactgcaatgtgtatattgtatgaagctctacggaacaaaattaatgtgtcactgataattaaaagaaccnccanaaacagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451795 - DNA, 2850 bp, Homo sapiens
  misc_feature (328)..(328): n is a, c, g, or t
  misc_feature (396)..(396): n is a, c, g, or t
  misc_feature (467)..(467): n is a, c, g, or t
  misc_feature (2836)..(2836): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggctgatgaattcgnatcctcgggtcacc

SEQ ID NO: 451796 - DNA, 1619 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaatacccctgaactctgagagtgaccagtaaccatacatctgtggggtggctttaagaagtgggctgggattagtgagagcgatccggaacaggagcctaattacagatggttagccggcgattgaggttgtccctctggggccaagagtcagtctcaaagggagcctatttacagcaatcctgggctttatcacttgcccggatatggggagggccacctttcgcggggagacacacaatg

SEQ ID NO: 451797 - DNA, 295 bp, Homo sapiens
tgttaaattcctactcatccgttaggactgaactccagtgttagctcctctctgacctcctcttttccaatactttttcagactttacattgattgtaattctttatattgtctcttcttctatactaagttcttgaaaacaatagttacatgtatttatcttttttcccatgaccctttgcagtacctgggatatagtaatcactcaatgaatataaactgcacttactggcatgctcaaggaatgggctattaaggtaaattgaatttttggttgattcagtagtaaagcttt

SEQ ID NO: 451798 - DNA, 3450 bp, Homo sapiens
cggcccagctgagatatggcaagccccgtttcccgcaggctctgtggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatggggtaaagtccgcatggaattagagggggaaagtctgcactggaacctgctgtggccattttttttctgttgttgctgcttctctagtggagttactgcagcttagggatggttcctggaagtggacacattttacaaaaacgttttttaaatacacgccagctcttcgagaagcacttttttccttccgtcatgcttcatactatattgtattgtactaacccctcatgctgggatgagcgactgcctagcaagcaacccactgcctactaacatcaagaggggctaaataaaactgcattttccttgcaaggacaacttctaccgtatgaatatatattatatttatgtattatattttgtacaatagttgatcttgaatgcagacttcatttgtatttttcgtggtactacaaaatgtgtagaagttatggcttttctttcattagggtcttgttaggtggttggcaagtaagttaaattgtatgttgcatttttttccatgctgttttaacttgtaaatatatatgtatacatgtggaagatattattattatctagattactttaagccttttatctgatgtattatcagtgaaaaccatgctgcttattccctaatacaatggttctcaaactttagtgtgtatcagaatcaagatgagggcttgtaaaatatagctggtccctactcccagagtttccatttcaggaggtctgggatcaggcccaagaatttgcatttttaacaaattcctaggtgataactgataatgttggttcagggaacacactttcagaaccactgctttaatattttaaataagataatatgtgaggtgtcataaaaaccttcatcaaatccctatctcatttcatttcttaggcattttctctcttataaagtttcctggatttataaattttcattgattttactagaaagttttatttagcttttatttatttattgttctttttaagaaaaaaactgagagtttgaattaaaagtttaaatcattgctaggtccttagttattttttttcttttttctttttttttatttgaagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451799 - DNA, 970 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaagtaagaacgcatgctcattctttctggccgaatcttttgcactttaccttactggctattcagatacttcttaagcacttccatatcctccctcacactggtaagactatttatttcatcaatagtacaaaactttctgttagataaacatgaatccttactgctttggaatactttgtaggtaatttatatccagtgaggaaataatttggtagagaattaaaatacattacttatttaaatattgatgctatccaaacagaatcgaaaa

SEQ ID NO: 451800 - DNA, 4897 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaattgatgtgtgctggggtttggaactaaaagtagtttcaacagtgcgtgggttatgacatttcttatgtttctttgttcatgtgtgtatttagtagttaattttaagatgtcctagtgatctttaaaagaaaaatattgtaccattttttagaattacactttcacctttctttttgcaattgaaagtgatgatgtcaaagtgggatttctgtactccaaggccccacccccaatttagcaagcagaaaaacgttccttgtatcactttaccttggataattgggtgccattaacacaaacaggtcacaatcctgctgttttctagccctgtccaccataatgagattcaggaaacatcctgtcagcctcctggaaagcatccttgtctccttagtatttcatttacaaactacctcttaacagagactgcttttcaaattggccaatcttacctgttttgtgttgtgattgcattttcaaagagtaattattttcagcatatacagttttgaaacctgtagctcctatgcaataacatagttctatagacattatttgggggaaatgtagtaataactcaatctatgttgctgtcctagaaaggaaattgcatgatgaatctagattgtctttagagtaaagaaacacattcaaattcctgtaacttatcactttcagtgagtaaatttacttataccaaaggggattttttttctttcaggaatctaaggaaatttactttttaacctgagaaaaaaacttggttctgctttatataaacagtagagattattgtactataagtgattttgcctttttgccaaaatcctggaactcatctataattaacctcttcggagcaataccttaggttgggccttgctttactacttagaaatagctaaatttcaattttaaaaatctttgtgtgttataactgttaaattattcaataatacttagggtttactttcttatttaaatcacttatttagtttaccgacttcatttttctttggatttagaagaagcaattatggaaaaacttggtaatctctctcaacctataaccttacacaggaagaattagagtttaataatttttaattcttttattgtatgttacttttattacaccagtttgggggaaaatcttcataaaattgtatcagttttattcagtgttctctaaggtgataccttttaattttgaaagactaaataattttaatcgagaatttccagtctttcagtctgatctatttaattcactacttgttacataatccagtgaaaactctacttgttgaaattatgacataaagatcttgcagctttatttgagtatttgttcttttgtgtagtttccatcttttaaaatatttaaaatattttcaagataaagtattatcttctctgcaaaaattcctggagtaattttctctcataatatttgaagtcagtggttctcagttgtattagtggggtaactacatcaaaataaataaagtcttatttttaaaatgc

SEQ ID NO: 451801 - DNA, 2977 bp, Homo sapiens
taataaaattcttaaatattggctatattgttacagcttcagggacagcatcttttatgttataggattatattttccatgtcgtgccctagcaatttaatcaattaggcttaactagacaagtttgttaatctgtaattactttacatcttgttattaaaaatttatcttttacatctgatggctcaataatgtctatctcaacctttactgtttcacatttacagtgaaaataaaacccagctatcatactgaaggtagattggactgttgtttcttcttgaagtatcttctgaaaataaacaccaccaaattttattagtacattaggagcttagcgtttaatgcaatattatatatgtgttaatacctctcttctggtattttaatggcaaggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451802 - DNA, 2357 bp, Homo sapiens
tttgtcttttttttagtggttgtctatatatacatatatatatatatctagtcacagaaatgactattttatgagacctgagttgacatatgtataatcattttctagtgaagatcatgaaagaggaatttgttttctacatttaatagaattgtggatttaggaaacaaaaactttaggacacctgtacagttgtatcacattttacttttcaagtttgcttgacagggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaa

SEQ ID NO: 451803 - DNA, 4886 bp, Homo sapiens
  misc_feature (328)..(328): n is a, c, g, or t
  misc_feature (396)..(396): n is a, c, g, or t
  misc_feature (467)..(467): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatggggtaaagtccgcatggaattagagggggaaagtctgcactggaacctgctgtggccattttttttctgttgttgctgcttctctagtggagttactgcagcttagggatggttcctggaagtggacacattttacaaaaacgttttttaaatacacgccagctcttcgagaagcacttttttccttccgtcatgcttcatactatattgtattgtactaacccctcatgctgggatgagcgactgcctagcaagcaacccactgcctactaacatcaagaggggctaaataaaactgcattttccttgcaaggacaacttctaccgtatgaatatatattatatttatgtattatattttgtacaatagttgatcttgaatgcagacttcatttgtatttttcgtggtactacaaaatgtgtagaagttatggcttttctttcattagggtcttgttaggtggttggcaagtaagttaaattgtatgttgcatttttttccatgctgttttaacttgtaaatatatatgtatacatgtggaagatattattattatctagattactttaagccttttatctgatgtattatcagtgaaaaccatgctgcttattccctaatacaatggttctcaaactttagtgtgtatcagaatcaagatgagggcttgtaaaatatagctggtccctactcccagagtttccatttcaggaggtctgggatcaggcccaagaatttgcatttttaacaaattcctaggtgataactgataatgttggttcagggaacacactttcagaaccactgctttaatattttaaataagataatatgtgaggtgtcataaaaaccttcatcaaatccctatctcatttcatttcttaggcattttctctcttataaagtttcctggatttataaattttcattgattttactagaaagttttatttagcttttatttatttattgttctttttaagaaaaaaactgagagtttgaattaaaagtttaaatcattgctaggtccttagttattttttttcttttttctttttttttatttgaagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtgatgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaaaaaaaaaaaaaaaaaaaaaaaaaccacaaacaaaaaacaaaacaaaaaaaaaaacaaaaacaaaaaaacaacccccacaaacacgacgcaccccccccacccgcgcccgccgccccacctcctgccccgacgtgaccaacgaggtcgcaccccctctgctgaccgcaacaactcccctccatctcccgactttcctctcacaccgcccgccgcccccgacaagacatcccatgcacagcatcatccccccgctcctcctctccgccgccacaccccccatcgcccaaccaccagaccccccacgcccacaccatccggcacaccaccgtccaacacgcttatccaccacgtactcccacgcttccaccacaa

SEQ ID NO: 451804 - DNA, 2503 bp, Homo sapiens
  misc_feature (328)..(328): n is a, c, g, or t
  misc_feature (396)..(396): n is a, c, g, or t
  misc_feature (467)..(467): n is a, c, g, or t
  misc_feature (2465)..(2465): n is a, c, g, or t
ccagttcggtaggagagaaagcccccgcagcgcccacagtccgtcccccgccccgcgcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctctccaatcggagggcntcgcttcaggtctcccgcctctcctcttacacgctcactttcttctccaataagcgggctcgaaaagnggggcggtgaccggcgaggaatattgggaattgtagttttttggacccacgggacggcagagctggagctncgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacnctgtggaattttcactttgggctagcccaaagtgaaaa

SEQ ID NO: 451805 - DNA, 1620 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451806 - DNA, 1566 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451807 - DNA, 1667 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgtgagtaaagctgggactagaagcgaaggattgagttctgggctagggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451808 - DNA, 2193 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaagggaaaaaaaaaaaaaaagcacactccaaaaatttgagcgcagaaaaaaaaaaaaaaaaaaaaaaaaaaaaaaaaaacaacaaaaaaaaaaaaaaaaaacccacaaaaaaaaaaaaaaaaaaaaaaacccccccccccccccgggtttttttttttttttttttgggccggccccatttaaaaaagggggctaaaaatggaaattggaaaaaaaaaattccttttaaaaaaaaataaccttttaaaaaggaaatttttccttttctgggaaaaaaaatctaaaattttttaaaaaacggccaattttttttccgccgaaataaaaaaaagaaaaggggcacacaaaattttttgcgccccctagaaggccccaaagggggggatgggtccccccgttttaaaaaaaaaaaaaagggccctcgggtttttttttttttccccaccccaaaaacttttaaaaaaaaaaaaacccacccttttttgtgccccggtttgaccccccttaagattctcaaaaaaaaagagaaattttgcccccctaaacatttaaaaggacacttttaattttttgtaaaaa

SEQ ID NO: 451809 - DNA, 1332 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtcagtccaggctggaatccaagaacctggagtagtggtgggttggtagtgatgccaggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451810 - DNA, 2096 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacgtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaagggaaaaaaaaaaaaaaagcacactccaaaaatttgagcgcagaaaaaaaaaaaaaaaaaaaaaaaaaaaaaaaaaacaacaaaaaaaaaaaaaaaaaacccacaaaaaaaaaaaaaaaaaaaaaaacccccccccccccccgggtttttttttttttttttttgggccggccccatttaaaaaagggggctaaaaatggaaattggaaaaaaaaaattccttttaaaaaaaaataaccttttaaaaaggaaatttttccttttctgggaaaaaaaatctaaaattttttaaaaaacggccaattttttttccgccgaaataaaaaaaagaaaaggggcacacaaaattttttgcgccccctagaaggccccaaagggggggatgggtccccccgttttaaaaaaaaaaaaaagggccctcgggtttttttttttttccccaccccaaaaacttttaaaaaaaaaaaaacccacccttttttgtgccccggtttgaccccccttaagattctcaaaaaaaaagagaaattttgcccccctaaacatttaaaaggacacttttaattttttgtaaaaa

SEQ ID NO: 451811 - DNA, 2058 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagtaccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacgtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaagggaaaaaaaaaaaaaaagcacactccaaaaatttgagcgcagaaaaaaaaaaaaaaaaaaaaaaaaaaaaaaaaaacaacaaaaaaaaaaaaaaaaaacccacaaaaaaaaaaaaaaaaaaaaaaacccccccccccccccgggtttttttttttttttttttgggccggccccatttaaaaaagggggctaaaaatggaaattggaaaaaaaaaattccttttaaaaaaaaataaccttttaaaaaggaaatttttccttttctgggaaaaaaaatctaaaattttttaaaaaacggccaattttttttccgccgaaataaaaaaaagaaaaggggcacacaaaattttttgcgccccctagaaggccccaaagggggggatgggtccccccgttttaaaaaaaaaaaaaagggccctcgggtttttttttttttccccaccccaaaaacttttaaaaaaaaaaaaacccacccttttttgtgccccggtttgaccccccttaagattctcaaaaaaaaagagaaattttgcccccctaaacatttaaaaggacacttttaattttttgtaaaaa

SEQ ID NO: 451812 - DNA, 1884 bp, Homo sapiens
aatgaatgatatcagtcagagtagggaagggaaaagaggcttcaagaatgactcagctttcgtggactcagcaactgagtggctggtggttttgttttctaaaattgggaaagactagggagtgtgtgtgttggtggggggcagaaatcagtttgggcatattaggttttgggtgcctattggcaccccataagcatgtcaggtaggcagctgatttggagcctaaacctcaaaggagaggtcagtcagagctgacgagaacagattggaagtcatcagcatatagatggcatttaaagcccctggactaggtgagattaccaaggaagtgaaggtagagagagaagagaagaggcccaaagtaggggattccaatatttagatatcaggttgaagaaaagagtagtcaaaaaagataagaggaatactgggagagtcaggtgtcacagaagccaagttccaaaaaaagacatttaaaggagaaggaagtagtgagcagtccagtgctcctgagaggtagggtcagatgagaacagagaattgaccatgagatttcgcaaattggagaatactagcaacctggataagaacaatttcaatggttgagggaaacagaagtgtaattgaagaggattgaggaaaaaagacaaatgggagcctagataattccttaataagttgttgtgaaaagaggagaagaaaaacggggtgctagcccagctactccctcactcttccaccacctcatagggagagactggagaacacagccagagtgagaacattcagtagaagtggtgcttcctttttaagttctggacactgtatttcattatctataaccgcatctctgtacatggacacctgaaatccttagggagtgcccgccaaccccatgatgttggccttacctggaaacttagccactgttttccacacttgcctttctttcaggcacctgctgattccagtttcagccagggcacagtgcccaacattgctgaccaagtcttgctctatttctccttctcacctggcctcttccatcttggcctctggatgcattctctccctctcatgactcatttctgcattcatcactagcctcttctctgcctgggcttctgccagcggccctagagcaacctatggtattccacggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451813 - DNA, 883 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtcagtccaggctggaatccaagaacctggagtagtggtgggttggtagtgatgccagtagtgatggtgatagtggtagtgatggtggtggtggagccactatgtggctttttaaggaagggaaatagagaagccacgtatggtctagaggtcacgtgagggaaggagaggaagtcattctggtgaaggcaactgtgtgtaattctgtgtgaatagtccctcattgttccccatgacccttaggacaaatctaccctctttagtcttacatacaagtctctccatggccaaatccctattggcccttcagctttgacttttattatactttt

SEQ ID NO: 451814 - DNA, 1600 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacatatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451815 - DNA, 1582 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagtaccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451816 - DNA, 1882 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggtgagaaagccctagcacttgagacctgtcagaattcatccactttccctgagcttgtggatctcacgtgtcctagctctcactttaactccgtgttgcgacaccttggcccttaatctagccccatttccattctggattttcccattgccctcatatggggaaacccacaccccactaaccccagccatctcttccaccttggacctcactctgacctctggcctccttctgtgttctcctcacccatttctctctccaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451817 - DNA, 1509 bp, Homo sapiens
gtgacatgttgttccagaggttccggaatgtgtgttttcctgttggaaggaaacttcgcagagtagaaaagggatctgagacttttggactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgcatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451818 - DNA, 1551 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacgtccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451819 - DNA, 1379 bp, Homo sapiens
agggcgtaacccggtctcaccaaatgcctgttgattgattggacaaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggtgagaaagccctagcacttgagacctgtcagaattcatccactttccctgagcttgtggatctcacgtgtcctagctctcactttaactccgtgttgcgacaccttggcccttaatctagccccatttccattctggattttcccattgccctcatatggggaaacccacaccccactaaccccagccatctcttccaccttggacctcactctgacctctggcctccttctgtgttctcctcacccatttctctctccaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451820 - DNA, 599 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatgagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaaggga

SEQ ID NO: 451821 - DNA, 803 bp, Homo sapiens
gcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagctgtcacatgactgcatcctgcctgccagggctgcaaagcaagggtcttgccttctatctgggggacgctgctcgagagaggccgagaggccgcagaacattgcccaggtgtcctcacttcaccccaaccctccccaattccaagccctttggccctctcggtcaagggttgggccaggcccagtcacaaggagcaagtgtaacctggaaaatacagtgacctgcctacattaacgggcatcagcccatgaacaggtgagagagtgg

SEQ ID NO: 451822 - DNA, 513 bp, Homo sapiens
tgcttgagcccaggaggtcaaggatgctctgccaccatattccagcctgggcaacagacagagtgagactctgtctcaaaaaaacaaacaaacaaaaaaacctcaggatgtatagagagagctgccagaacgttgatctcttccattggatcataaattcagagaggtgaaaactgtatcatattcatctgtaatccagtgtttattcttttccttaggagagggaaaaaggggcaatgtgcaagtgaaaatcgagtctggaaaaggggcttctacaggggtgttggtgtagttctctgatcagcagcaccggcatggatgtgggagctcggaggaaatacactctcaggccccaccccagacctgaatctgcatcgtagcaaaatccccaggtgacctgtatgcacgttaaaggtttgagaagcacagggtagagcacttgagattgtgtaggttccaaatccacctgtcaacagatggaaggaggggatgcatcctcctgggtttcctcag

SEQ ID NO: 451823 - DNA, 1389 bp, Homo sapiens
gcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaaaaaaaaaaaaaaaaaaaaaaaaaaaaaaaaaaaaaaaaaaaaaaaaaaaaaaagaaaaaaaaaaaaaaaaacaaataaaaaaaaaaaaaaaaaaaaaaaaaaaaaaaaaagaacaaaaaaagaaaaaaaaaagacaacaagggggactacaagcaaaccccagacaaaggagagaaagagagaagaaaaaaaaaaagcaaaaagaaaaaagaaaaaaaaaaaaagaaggaagaaaaaaaaagaaaggaagaaaaaagggggacaaagagagaaaaaacaaagaggagaaaaaaacacaaaagaagagacaagccagagagaagagagaacagagacaagaaaaaaacagaaaagaggaggaacagcccgaagaaagggacagacggggaaaaaacgaag

SEQ ID NO: 451824 - DNA, 1326 bp, Homo sapiens
gcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaaaaaaaaaaaaaaaaaaaaaaaaaaaaaaaaaagaaaaaaaaaaaaaaaaaaagggggggttttttgggggggggggaaaaaggggaaaggcgacgcagtgtgcagaatcaggtcttctccgagcaccaccaacttctttgtcgcaacgagggggggaacaatcagccagggagggcccccccaagaggagggggggcgagataaaattgtccgaaaacaggcggggtttctccgcgtttttttttgatctgtcgggaaaaaaactccagccgccaccagcccacccacccagacgatgcacatccgcaaccgcacacgcaatcatcaacctcatgt

SEQ ID NO: 451825 - DNA, 1165 bp, Homo sapiens
gcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagttaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatctagggaaatttcatgtcacttccctccttcactgcatcacaatcatattcccttttttttttcttggatttgtgtcagttggatgatatcccctccagatagtatcaataaaatgttaaaatta

SEQ ID NO: 451826 - DNA, 1271 bp, Homo sapiens
gcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaaaaaaaaaaaaaaaaaaaaaaaaaaaaaaaaaaaaaaaaaaaaaaaaaaaaaaagaaaaaaaaaaaaaaaaacaaataaaaaaaaaaaaaaaaaaaaaaaaaaaaaaaaaagaacaaaaaaagaaaaaaaaaagacaacaagggggactacaagcaaaccccagacaaaggagagaaagagagaagaaaaaaaaaaagcaaaaagaaaaaagaaaaaaaaaaaaagaaggaagaaaaaaaaagaaaggaagaaaaaagggggacaaagagagaaaaaacaaagaggagaaaaaaacacaaaagaagagacaagccagagagaagagagaacagagacaagaaaaaaacagaaaagaggaggaacagcccgaagaaagggacagacggggaaaaaacgaag

SEQ ID NO: 451827 - DNA, 1011 bp, Homo sapiens
gagggagtagctttttttatttttattttttgagaaagagtcttgcactctgtcgcccaggctggagtgcagtggcgtgatcttggctcactgcaacctccacctcccaggttcaagcgattctcctgcttcagcctcccaagtaactgggactacaggcatccgccaccacatctggctaagttttgtatttttattagagatggggttttaccatgttggccaggctggtcttgaactcctgacctcaagtgatccgcccaccttggcctcccaaagtcctgggattacaggtgtgagccacctcgcctggccgagagggagtaactttggagctgcacttcactcagcattcacggtactagcgcccgctttttgcttcagactgacattccacatcagtattaaaatcattcacggttatttcctttctcctttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagttaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatctagggaaatttcatgtcacttccctccttcactgcatcacaatcatattcccttttttttttcttggatttgtgtcagttggatgatatcccctccagatagtatcaataaaatgttaaaatta

SEQ ID NO: 451828 - DNA, 1283 bp, Homo sapiens
gcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagttaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatctagggaaatttcatgtcacttccctccttcactgcatcacaatcatattcccttttttttttcttggatttgtgtcagttggatgatatcccctccagatagtatcaataaaatgttaaaatta

SEQ ID NO: 451829 - DNA, 1393 bp, Homo sapiens
gcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagttaaagtgcgtgtctagtgtcttctaaaaaaaaaaaaaaaaaaaaaaaaaaaaaaaaaaaagaaaaaaaaaaaaaaaaacaaataaaaaaaaaaaaaaaaaaaaaaaaaaaaaaaaaagaacaaaaaaagaaaaaaaaaagacaacaagggggactacaagcaaaccccagacaaaggagagaaagagagaagaaaaaaaaaaagcaaaaagaaaaaagaaaaaaaaaaaaagaaggaagaaaaaaaaagaaaggaagaaaaaagggggacaaagagagaaaaaacaaagaggagaaaaaaacacaaaagaagagacaagccagagagaagagagaacagagacaagaaaaaaacagaaaagaggaggaacagcccgaagaaagggacagacggggaaaaaacgaag

SEQ ID NO: 451830 - DNA, 1214 bp, Homo sapiens
gcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcgcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagttaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatctagggaaatttcatgtcacttccctccttcactgcatcacaatcatattcccttttttttttcttggatttgtgtcagttggatgatatcccctccagatagtatcaataaaatgttaaaatta

SEQ ID NO: 451831 - DNA, 1339 bp, Homo sapiens
gcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagagagggaaaaaggggcaatgtgcaagtgaaaatcgagtctggaaaaggggcttctacaggggtgttggtgtagttctctgatcagcagcaccggcatggatgtgggagctcggaggaaatacactctcaggccccaccccagacctgaatctgcatcgtagcaaaatccccaggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagttaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatctagggaaatttcatgtcacttccctccttcactgcatcacaatcatattcccttttttttttcttggatttgtgtcagttggatgatatcccctccagatagtatcaataaaatgttaaaatta

SEQ ID NO: 451832 - DNA, 389 bp, Homo sapiens
tcccatgcaaccacaggatgagggctgagcggcctcatcctcacattcagcagagtctctcacaggcctctgctttgttaatgccctccaaaccccatgcattttctaaggcccagaaagatcttcaacttacttagtggtcatgtatcttccctaaggctgtgagcctaatccatccacttatgccttgtgttactgctacgttagctgtcacctgcagctgatggcagttttaatacacaaagaagtggctgctttcctcttaatggagaagcaaagtctattttgcctgctcttgaatcttgactgccctctgactgcctttttgaagtaatagaccttaccgtaaatatgtttgttacaatgagctggaacggatttaattgtaa

SEQ ID NO: 451833 - DNA, 610 bp, Homo sapiens
ccacaacaccattaccaaatgagaaatgtgggaatttcttcaatattaagagggagaaaaaggccaattttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451834 - DNA, 768 bp, Homo sapiens
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcaggtgcggcaccttgctcccccgcagagcctccccgtgtgcgcactggtcctgtgcgttccaggcatccccagagcacgagcgtctcggggctggacccagatgcagctgcccgaggtgccctcttcgtggatgggcaggcgggggcttgtgctgtaaaattagtccaggctgggcttgtcccccatggccttttataaggtggagggacctagaggctcggagaagtgtggtgggtttttcttcctgacagggcggctgcccggggtgctgtgttctccatggggtactaacatctgtgaagtctgtgatgctgaaggctcttgggggccctgctcaggtctggccattctggggctgcaggtggccctgtcctcgcgtatgagctggcctgaccctggagagacactgccctcatgtgcggtgtggttttccattttgttaggaaa

SEQ ID NO: 451835 - DNA, 604 bp, Homo sapiens
caccccaggaatggcgcccgcaagtccggggaggccgtcctgccggcccagcgcgtttcccgcgtccacgaggtccccgttccgccggcactggcggcgtccagcctgggtttgcccgcgctcgccgacgtggcggcctggccaagctcggcgccgctcaccagcgctgacctgggggtggtttgacctcccagtgcctcagtttcttcacaggtaaaacgggtcttcttgaggacgggtgtggagggcccggggcagccccgtaggagcgttggccaaaggagcccggcctggggctgacaggaaaccgcggcggcagggaggcgggtggcgcccccaatcgtctagggtgctggcccgattcgcgcggcccccgcggacgggaccccgcgggccgccttctccgctctgtccgcggctcctgagagggaacgtcacccccagcgtcctccctcctccgccccaggtccctgcggccatgggcggcggccccggcctcacttcccggcgccccaggaacgcggcccccaggaaaggagtcggggcccgggcgacgcggggaggcgggcaagggtccccagggcccgggctccccgtaaacgct

SEQ ID NO: 451836 - DNA, 531 bp, Homo sapiens
agtctctggtgtcttctgcaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagggcatcatactgtcatggaaagagctttggacctggaaacagacttttttttttgagacggagtctcgctttgttgcccaggctagaatgcagtggcgcagtctcagctcactgtgcaagctctgcctcctgagttcacgccattctcctgcctcagcctcccaagtagctgggactataggtgcccaccaccactcccggctaatttttttgtatttttagtagagacggggtttcaccatgttagccaggatggtctcgatctcctgaccttgtgatctgcccacctcagccccccaaagtgctggg

SEQ ID NO: 451837 - DNA, 241 bp, Homo sapiens
gatgacccatcatctcaagcaagcaagagatgatgggtcattgttcaggtgactgtaaaaaggcagagaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451838 - DNA, 2283 bp, Homo sapiens
  misc_feature (1873)..(1873): n is a, c, g, or t
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtcaaaaaaaaaaaaaaaaaaaaaaaaaaaaaaaaaaaaaaaaaaaaaaaaaaaaaanaaaaaaaaaaaaaaaaaaaaaaacagggccgcggccgcggggcggcgccgcacggaggagaagctatagaaaaaacacatcgacagggagaggaggagggggggccacgcagcgggcagcaacagaaagaggggaagaaagagataggaacaggaggagcacagcgacgggagcactgagcgggcgggagggaggcgagcgcgcgcgcaaaacaacaaaaaccgacgaggggagagagaggcgcgagagagggagactaccggaagaagactatagacaagaagaactcacatccgtgggagagaccacacacgggaggagattctcaggcggaataaagcaagacgaaggagcggacacacagagccagaagaaaaaccccacaaagcagcaggggacaggggagaaga

SEQ ID NO: 451839 - DNA, 1769 bp, Homo sapiens
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451840 - DNA, 1672 bp, Homo sapiens
aaactttgcgcggcctctgcgcggccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451841 - DNA, 1764 bp, Homo sapiens
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451842 - DNA, 1868 bp, Homo sapiens
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacaggtacggagctggcttcgcgtggttccagggcgacttccgatttgtgcgggctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451843 - DNA, 1579 bp, Homo sapiens
tattcctaatttgttgagagttttcatcataatgaatgttgaatttcatccaattaagctatactggcagtcaaattgattggattggaggatagaaagcattgatcctgggtgtgcctgtgagggtgttgacaaacgagattaacatttgagtcagtgggctgggaaagggaggcccactcttaattgggtgagcaccatctaataagctgccaatgtatataaagtaggcaggataccgtataaaggagagactggcctaagctcccagtctacatcttttgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451844 - DNA, 1319 bp, Homo sapiens
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451845 - DNA, 1576 bp, Homo sapiens
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgc

SEQ ID NO: 451846 - DNA, 1818 bp, Homo sapiens
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451847 - DNA, 2104 bp, Homo sapiens
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtcaaaaaaacaaaacaacccaaaaaaaacaaaaaaactgtggtgggagcgccttgggccccagaaaaaggcttctaacaccacttgcgttggagcgcggggcccccagtgtctagcgagacacgtggacaagacacgggccgccaagagaaaccgcgacagaaacaggtccgtgggtttcccacaatataaaaaaccgccggggcaacaacgagggtcttggaccacctcaagggggcccggaggacatagcggatcattcacaggaggccaagggagccgaatcaat

SEQ ID NO: 451848 - DNA, 1838 bp, Homo sapiens
caccccaggaatggcgcccgcaagtccggggaggccgtcctgccggcccagcgcgtttcccgcgtccacgaggtccccgttccgccggcactggcggcgtccagcctgggtttgcccgcgctcgccgacgtggcggcctggccaagctcggcgccgctcaccagcgctgacctgggggtggtttgacctcccagtgcctcagtttcttcacaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451849 - DNA, 1561 bp, Homo sapiens
  misc_feature (55)..(55): n is a, c, g, or t
tatacgaatcgagctcgtgtacccagcggaacaagcaagctgatgaaggcctacngcgagaggcaggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451850 - DNA, 1721 bp, Homo sapiens
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtc

SEQ ID NO: 451851 - DNA, 1140 bp, Homo sapiens
  misc_feature (768)..(768): n is a, c, g, or t
  misc_feature (858)..(858): n is a, c, g, or t
  misc_feature (869)..(869): n is a, c, g, or t
  misc_feature (880)..(880): n is a, c, g, or t
  misc_feature (885)..(885): n is a, c, g, or t
  misc_feature (890)..(890): n is a, c, g, or t
  misc_feature (904)..(904): n is a, c, g, or t
  misc_feature (908)..(908): n is a, c, g, or t
  misc_feature (914)..(914): n is a, c, g, or t
  misc_feature (921)..(921): n is a, c, g, or t
  misc_feature (923)..(923): n is a, c, g, or t
  misc_feature (952)..(952): n is a, c, g, or t
  misc_feature (959)..(959): n is a, c, g, or t
  misc_feature (969)..(969): n is a, c, g, or t
  misc_feature (981)..(981): n is a, c, g, or t
  misc_feature (986)..(986): n is a, c, g, or t
  misc_feature (994)..(994): n is a, c, g, or t
  misc_feature (1011)..(1011): n is a, c, g, or t
  misc_feature (1015)..(1016): n is a, c, g, or t
  misc_feature (1139)..(1139): n is a, c, g, or t
tgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggagggtgtgaagacagagaatgaccacatcaacctgaaggtggccgggcaggacggctccgtggtgcagttcaagatcaagaggcacacgccgctgagcaagctgatgaaggcctactgcgagaggcagggcttgtcaatgaggcagatcagattcaggttcgacgggcagccaatcaatgaaactgacactccagcacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttcccccccttttaaanacaaaattataactgcatgtcgctttatctgcaggatctgactctgatagtgctctcctgtcatcatcactagagattgtgttccgcatngggtgcatgtngaagtatgggncagtngtagnagaagatgtcatgntgtnaagcanagtgatnangtatatgcatcactgtatatgtaatgagnaatatgnagtctcagtnaatacgatcttngtatntacatgtntgctcacatatcggtgncatnncctgcactcacatctgtatatctgtaagcagtgaacaatgcttttcttatgaatcaattatgagttgtgatctaatgtatagtagtataatatagttgatcatattgtaatatcatgtatacng

SEQ ID NO: 451852 - DNA, 5676 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451853 - DNA, 272 bp, Homo sapiens
aaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatttaacttgttgccgtttgaagtaaaaaatttccaaaatgtatgctcaacaataatcattaaaatgtttgcagcgta

SEQ ID NO: 451854 - DNA, 5050 bp, Homo sapiens
  misc_feature (6)..(7): n is a, c, g, or t
  misc_feature (33)..(33): n is a, c, g, or t
  misc_feature (38)..(38): n is a, c, g, or t
gcggcnnctactactactaaattcgcggccgcntgacnatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451855 - DNA, 5147 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451856 - DNA, 5508 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacagatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451857 - DNA, 5482 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttcatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451858 - DNA, 5924 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggttttctttgtatattataaacatttatttaacttgttgccgtttgaagtaaaaaatttccaaaatgtatgctcaacaataatcattaaaatgtttgcagcgtaaaaaaaaaaaagaaaaagaaaaaaaaaaaaaaaaaaaaagaaaaagaaaaaaagacgtgaaggaaaaaaaagaggggggggagagttggaggaggggggtataagatgtcatacttggaccacgacatcgcatgcatccacaatcgccattcattccaacaccgtcgccgcgcgtatcacacgcacagccttcaacccggcgaagcaactctgtggtgagagacccacacactgacgcaagcacagagagcatcacgacactgcgcaataatgacacgtcagcgatgaatctcccacagtgtagcttgcggcggctgatacatgggcatcagtgagaactgtatacaatagacaaaatgagatagacgcaacacgctcgactcggatcagagactccatgcaacagtcacactcagcggccgtgctatcctccgtcccccagg

SEQ ID NO: 451859 - DNA, 5477 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcactacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451860 - DNA, 1329 bp, Homo sapiens
gaaaaactttattaaacccatctctaaaggcttccattgtttctgaatacccgtatgcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451861 - DNA, 1167 bp, Homo sapiens
agaaaatagtggtagtgattttcatttaaatctgcagtcaactcaatataactatatttttgttcttttagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451862 - DNA, 1120 bp, Homo sapiens
cacggttgtacgcaaggttgagcctgggatgcaggttagccagtccacctgggggtagagttgaacaaccagtggtaaactgcaagaatgctttcctttcatcagaagacatgccacataaaaccctcacaaacctcaggaaaccagggctgtcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451863 - DNA, 566 bp, Homo sapiens
  misc_feature (6)..(7): n is a, c, g, or t
  misc_feature (33)..(33): n is a, c, g, or t
  misc_feature (38)..(38): n is a, c, g, or t
gcggcnnctactactactaaattcgcggccgcntgacnctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451864 - DNA, 3987 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggtaatctcatataaaattagatttagggaacaggaatgacacttagggaaccagcccaatgtgtatcttcactgcattaaaaactgtggtaggtaaacatgaagaggggttttcctgttctgtaggcagaagccttctcctctggcagagcatctttttcataagaggatgtcagtccacctccttaggggttaggtcttgtgccattaatgagcaacaaagaagatctccactcttgaggtggcaaagtgcttgttctgcttgagggcttctacccatttcataacaaagttggactaaaatagtagtactcacaagggattcttttttacttttacattaaactgtgctgtttgatattttgggagcacctggttttgtaatattgtttcacttgaattgtgcttggtattatatcactggtctgtgttgagacatgttatagcaaatggtagtatgacatttaatatatttagtttagaaatgttactgtggacattgttggttttatttcatatacacagtattccctatatgaggaagagtggaaatacgtctcctgtcacaggggtgaatccaactggtttgtttttaacttttggatcataaactaattgc

SEQ ID NO: 451865 - DNA, 2247 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacagatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaacgaagacatcatggagaggataaatagattggcaagccttttctatgtcttttccaatgctgtctggaatctatttatgaccactctttcaagtcatttgtctgcacctctggtcaactcgccc

SEQ ID NO: 451866 - DNA, 712 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaagagtgcacttttgaaaagtgcactccttagtatgatctagatgctcagaaataatgtcttagccaggctgtctgggcatcccgcagcccactcaagttgaccacaaggttgaatcatcatagtggtctacaggggaaagatgctgagggaaattttttttgcagttctagagaatcaattaccagtagaatactgtagatatag

SEQ ID NO: 451867 - DNA, 788 bp, Homo sapiens
gaggaatgtgatgagcacagcaagtaagtgagcttttccttctggaatccgatgctttttccacttggagggatgcaaaatagggtctcttgttctggctgcagtttttaactagatcattaaccatgttagataaagctacatcaaatttagcagttcaggaatatgaagttctctagaatcataatatttgcagaattcagactaggtgtgataaagaacctcttattttagaagcataaaacagtacttctgattttcactcctttatgatacatcattaagcaaagttgcatgaggaaatagatgactattaaatattatcatagtgcagtgaaaccaaagcatcatataagtatagcttttgtttagactctacattgatcttagcttctgaaagttaaattccaatttaagctgctaacaggtcaaagtaattatataatagtgctataaaaagaatttttagttggatttcagttgggttcccaaagttgttgcttttcaggaaccattttattattagtgtgttttatgacctcactctttaaaaaataaaaaacttggtttttctgaggtttctacaatctcacctatttgtactgatttgcttcatttttgtctttagcttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccac

SEQ ID NO: 451868 - DNA, 417 bp, Homo sapiens
accatttgaaactagacagctttatttcacatgtacagcatttggcgcctcaaggtaagaagccttttttttatgtttttagaataagtatgcttttatgttatgtaagttgaaaatgtacaactatactgtcaagactgatagagggaatatattatcttgtattcttataaagaatagtcagcattgccttttggcctgaactaccaatcttctagtaattcgccaaaatgactaatccaaaggaaaggaggagagatacccgatagatgttttctaggtcttttagaaaacatggagttgttcctttggccacgtatatgcaaatctaaaagagaggtgatactgtagacattaagggaatgggtactgttcaaaaaggaatgccccacaagtgttaccgtggctaaactggaa

SEQ ID NO: 451869 - DNA, 601 bp, Homo sapiens
atagtaaaactaacacagtattgcagttgaacgttgaagggaataatgactaacatggaattctttagattagaccaagtgcatgatcttaaagctacctcatgtaatgcatgtgaaatatcatagactttataattgggaaaggccaacatttggtttttcctgttgtagggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggtatatattggcatcaaaacactattttgattgcaaatggcttcgtgctttgttttgcagctttggaagcttcttaaggaacagcagttcattgagacataattttaaaaatgaggttgaattaacactgttaatgcacaaattctaaaatttcaaatatggctggtagcattggatctgaatgcagactttgaccatggcttagagtggttatattttatttgggaattttaatggtttagaatgc

SEQ ID NO: 451870 - DNA, 459 bp, Homo sapiens
gttcatagttctattatgtttatagttaataaatccaaatctcagttgttttagggtatatcattttttacaattctgagacagaaaccaagacgttttccagagtattttgatcgtttttgtgtagatacttacaaggagattacgatttcggttggaacgtgcacctggtgaaactgcattgattgacaggactggcagaatgttgaagatggaacctttggctacagttgaatctctggaacagtaccttttgaaaatggtgagtttctggcaagggcacggtgaaataagcattctgagctgtggtttagccttttaggacaataatttgggaagtatatatccagagttatggtaatacagtttggcccagtaattccattttagaactgatttctacatgaagatgtttattataattttgtaatattgaaatagtaaacaaaaaccttaatt

SEQ ID NO: 451871 - DNA, 1189 bp, Homo sapiens
ggcacgaggctcaggaaaccagggctgtcacgtgtataacctcaggtttgtcacgtgtataacctcaggaaaccagggctgtcacgtgtataaccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451872 - DNA, 5535 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451873 - DNA, 5978 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgtaaaaaaaaaaaagaaaaagaaaaaaaaaaaaaaaaaaaaagaaaaagaaaaaaagacgtgaaggaaaaaaaagaggggggggagagttggaggaggggggtataagatgtcatacttggaccacgacatcgcatgcatccacaatcgccattcattccaacaccgtcgccgcgcgtatcacacgcacagccttcaacccggcgaagcaactctgtggtgagagacccacacactgacgcaagcacagagagcatcacgacactgcgcaataatgacacgtcagcgatgaatctcccacagtgtagcttgcggcggctgatacatgggcatcagtgagaactgtatacaatagacaaaatgagatagacgcaacacgctcgactcggatcagagactccatgcaacagtcacactcagcggccgtgctatcctccgtcccccagg

SEQ ID NO: 451874 - DNA, 5533 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttgctgaccttccctccactattgtcctatgaccctgccaaatccccctctgcgagaaacacccaagaatgatcaata

SEQ ID NO: 451875 - DNA, 5502 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451876 - DNA, 4605 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctgtatatagttgcaagtgacccttattcaagaatatcccaggaagatggtgatgaacagcctcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgta

SEQ ID NO: 451877 - DNA, 2864 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacgtaagaaattttaacttaatgttttggtagataatgtcctagtgtagagccaagaagcattgcatttattttggattataggaacagaaaagattttgtttttattctgttggcttacaggaacagataatagtgtttgggactcttggtgtggaatgattaagttttagaagtagaaggacatttacagtctatactagcttcttacgtaattgttgaaaagagcgtcatttgaattctttgtctaagatcgtgtatgagtactaactatcttctttctgttcttgattttgggggtgtgtgggttaacacctgcctttctttgtacaaataatcataatagatttagggttgatt

SEQ ID NO: 451878 - DNA, 2120 bp, Homo sapiens
tttgtgtagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatggtaagttgtaatttaaaatgaaagtatttagatactttcataatgatgcttttattatgttttctcctgatattttaaacttttgtttaaagagaattattctctcttcttataaatatgaaatcttcgggccaggcacagtagctcacacctgtaatcccagcactttgggaggccgaggcaggtggatcagttgaggtcaggagttcgagaccagcctgaccaacatggtaaaaccccatttctacta

SEQ ID NO: 451879 - DNA, 442 bp, Homo sapiens
aataaataaattcggggccgcgtcgacaatgaggaaggacacagactctgcccccactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaac

SEQ ID NO: 451880 - DNA, 328 bp, Homo sapiens
ggggtggtgcagggcaggggtggtatatcctgtctgacggagggcgggcctcgccagtgccagagagggacgaaccagggtggaagcgccaggagcagctgcagggagccctcacgcggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaac

SEQ ID NO: 451881 - DNA, 5382 bp, Homo sapiens
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatatctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaac

SEQ ID NO: 451882 - DNA, 4604 bp, Homo sapiens
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatatctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtcctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaac

SEQ ID NO: 451883 - DNA, 3576 bp, Homo sapiens
  misc_feature (3556)..(3556): n is a, c, g, or t
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatatctattccggcttctagtgggatggagttggggtatagaaattaaccaggaagatgtttccaccaagcctgctgtgagtccttgtgggcatnacggtaccgagctcgatata

SEQ ID NO: 451884 - DNA, 3178 bp, Homo sapiens
ctgaggccagtctttcgccctgacacatgtacttagtgataagagagaggctgtgtgagccgaggttgctctgggagggcagtggacagtgtctgaccccacagcaagccccacacagttttgtgtcatttggttgctgtttctccctttgcagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatatctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaac

SEQ ID NO: 451885 - DNA, 825 bp, Homo sapiens
aagtgggtgatctagcaggagcttttttgcggtgcctttccccttagcactatcctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaac

SEQ ID NO: 451886 - DNA, 5599 bp, Homo sapiens
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatatctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaacaacacacaacataccaaaaacaataaataaaaaaacaagttgttgctgggccgaactagggccctaggaagaaagtttttgtaaaaccaattctggtttggaggccgaggggcccccaatctagtatacgtggaaccgttggccacaaagggggtcccctagggaaaaccgggggaccaagaatagggtgtgggattctcccagaataaaaagcccg

SEQ ID NO: 451887 - DNA, 3527 bp, Homo sapiens
gcggccgcctactactactaaattcgcggccgcgtcgacctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatatctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaac

SEQ ID NO: 451888 - DNA, 867 bp, Homo sapiens
  misc_feature (780)..(780): n is a, c, g, or t
gtcctactttctctctcaaactggctttttctcattcctttgactccgccagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaagaatcatctcttttgaaaaatcgattcatcaaatgaatcttcagccaacaactgttcaagaaggattcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggatncagttcagccggcttgcacaggtgaagttcggttaacgggggaatggggattgggggaaaaagtgggggaaggcggggcgaaaaggg

SEQ ID NO: 451889 - DNA, 615 bp, Homo sapiens
agcagctcaaggctcatggtcatcaccataagacaactcctctgggtctcccaacttctgctgaccctatgtgattcacagtcctgcccaaagactatcaatggatatcaaggtatttccaaatcaaagagaggtacttcaatagaggaaattataagggcggaataaagtgacataagtcaactgtgaaacttgattaagacctagaaaatggtccttttccatgcatataatatttgtaagagattagaggaagcctgtctcctgaatacattccttataccttcatatgtaaaacacttagcacatatcactttctggagcattgtaccacctgtctcatggaggattagtgtccttaaaggtacctggggttacagctatgagtggagaaattaatttgtgacatcattaaaatgactgcttctatttcagccaggtgaggaactttcaccaacagatgaaaatggaaaagtaatatttgacatagtggatctctgtaccacctgggaggtgagtgcttggcggagaggacacagagaaggatgacaaaaagagaaaatctgtttcccaggttcaataggaaagaatggaatatgcaccattagatctaga

SEQ ID NO: 451890 - DNA, 1807 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctggcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaata

SEQ ID NO: 451891 - DNA, 1616 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctggcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaaagtaaagagggggctcaaaaacggggttgggcacgtgagagtaaacaaggtgagaatccttagaattgggccaataaaaaaaaagagagcgttacacacgtggggggaaccaggacaacggcaccaacaaaaaagagcctggtggtccgcccgg

SEQ ID NO: 451892 - DNA, 1457 bp, Homo sapiens
gcttattgtgagtcaacattcaggacacagttgtttcttcagacagagttcactctatgaaaacactatgagcaagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaagttatttctaaacagaactaagatcagaattctttgaatcatcagaatcatctcttttgaaaaatcgattcatcaaatgaatcttcagccaacaactgttcaagaaggattcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaata

SEQ ID NO: 451893 - DNA, 1389 bp, Homo sapiens
gtcctactttctctctcaaactggctttttctcattcctttgactccgccagacttcctcgcccccatgacctggtgttgtgtctgatcaccccaacattcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaagaatcatctcttttgaaaaatcgattcatcaaatgaatcttcagccaacaactgttcaagaaggattcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaata

SEQ ID NO: 451894 - DNA, 1761 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctggcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaagcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaata

SEQ ID NO: 451895 - DNA, 1141 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctggcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccggcggacaaaccctcaccaacatgactcgtgcaggtgcgactgttagaggatgcaccttatggcgagtctctgtagacaccgagtcgtgcttggtcacgtatgaactgatgcacagc

SEQ ID NO: 451896 - DNA, 753 bp, Homo sapiens
tgtaaaagaaaggaagagtagcgagcatgagtaattcttatcatccattaaaaatgtaataagttggtgtttatctgttcctttatatttcatgttatttctatataagaatttttaatgcactgtagctccttggatattagaccctatatcatatataacaatttacatttctgaatcttacaaaatatattgcatacagtagacagtagcaggtaataagtaaagtaacaaaagaaagtataatcagagtatctctgctctgctgacagatgtacaggaatatacttgaatatttgactttgtgtgttttacgtgttaacttccagataagggaatatgattgaataatttattattttgaaaatactgtattatgaagccatgttcataaaggtaagaaaggcagattctacaactagtcagacaacttaacattcatactaatgacagcttcattgaaatcactttactactcccctagtaatggagtcattgcatttatattatacattattctcttttcagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaata

SEQ ID NO: 451897 - DNA, 1691 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctggcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggtaagaataattccttttagttttcggatttcaaaagaataaacctagtagaagtgaaacccgtattgggttgtaaggttcgtgttcctaccttactctggatgactcactggtctaggtttcctaggctaggagaaaaaagtaggcaatccttgttctgcattgaggtccattcctatggtcacgtactgcttatttttcgtttgtgcactgtttctttcttctgttcatgtctagttcccagcttggcagaatatgtaaaactcagtattgaagaacactgttggtcatctccctctggtggagattaattgcaataggagtgatttctctgtttctacaactgaagaaatctttccatcttccaagaacatacgatccagagaaatacttatagcaaaaattactggatatggtgtgcacaaaactgtcggcagagtatcactgttctgatgggcggcagtgagtgccacccagtattaccggacctggactagagtttccactgtactatttcacttttaaaaagaacttcctgaaagaaaaaaataccacctcattttaagtaaaatctagaacctaacaaaggaaagtctaaattcttagtccttttttgtatgcatcatatttgtatcaaagtggtaggagtggtcttctgacacaaaaatgaacaaaatggagacctcattttctagatagaacttgtattccaagactgtcctcaggctactaagtgtgtgaataggaactaattattgaaatttgagtctctcactttatcgataagttgtgatgatctacaaggatacattttctagaccagtgacaaaagtggtttaatttttaatataaattggcatgggcaggaaatgaaaataacgacacaactgaagctccagccttggtaaacctttgagtgttggcacacttaaagactgctctcaaaaaagattt

SEQ ID NO: 451898 - DNA, 515 bp, Homo sapiens
ttgttgctctcacagttctgtcttgcatttaccgtgatttgcagccaactgcacaaataattcctcacaacccctttctccacagggccatggagaagtgtaaggatgcaggattggccaagtccattggggtgtcaaacttcaaccgcaggcagctggagatgatcctcaacaagccaggactcaagtacaagcctgtctgcaaccaggtgagctcccttggccttctctcctttcggttcttcatgccccctcttcctgtcctattgccaaatatctgtttgttttgtcccagttatctttgtgaagtagaagattatctagagagcaaagcttctgtcaagaaaggcgtgaagatttcttgtttgtaccctgcttggaaaagtattagggaaaaattggaatgagtttaatgctgaatcgtgtgtaatatttaggggaggtccatttgatcagggaggcctggaatcatcaattagaactcaaggaaaggtggacttacctctaagctatga

SEQ ID NO: 451899 - DNA, 1408 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctggcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggacccaacttcccggggccttttggaggacccatccttttggccctgggagcacaagggcccgcctggttgccc

SEQ ID NO: 451900 - DNA, 1841 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctggcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataaattgaatgttttcctcaaagattctttacctac

SEQ ID NO: 451901 - DNA, 1278 bp, Homo sapiens
tgagggaagaagaaagaaacatttgctagccagctgagtgacagtgatggattcaaaacatcagtgtttgaagctaaatgatggtcacttcatgcctgtcctgggatttggcacctatgcacctccagagaatcatctcttttgaaaaatcgattcatcaaatgaatcttcagccaacaactgttcaagaaggattcaaatatcacaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaata

SEQ ID NO: 451902 - DNA, 1117 bp, Homo sapiens
tctcagccacagtgatcaccagatactacctttggttgctcctccaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaata

SEQ ID NO: 451903 - DNA, 1765 bp, Homo sapiens
ccctcatcaggattacagctttatcaggactgcatcttcttcagaaatgaatatttctcttacaacgcaaagaaagaaaaatcaaaataaattttctgattgaaaatgtaaaaaggcaaatatttttacagttttaactttaattttttattgaggaccaactatttgaaaaattctcattagtcattcctttaaattatgtgtatgtgagagaaagacgtaagatggttaattatttcaaatgatgcagtataaagaaggggcattatcacggcagaaacgaaaaaagatatttgtagctggaggtttttatagtctaacatatggttgctatttgttctacaaatccttttgaataatttaatatagagatttagaatagaaaataatactttagatagaaattaatgagtttattataaccatatattataataatttacttaggaattctctttgataagaaacaaatgaactgaatgcaattttctccacagaccatataagactgcctatgtacctcctcctacatgccattggttaaccatcagtcagtttgcaggggtggggggaggggtttcctggcccattgtttttgtaatctctgaggagaagcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggagccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaata

SEQ ID NO: 451904 - DNA, 1281 bp, Homo sapiens
acaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 451905 - DNA, 888 bp, Homo sapiens
aaaactaggctaggtacgaggctgggtggtgtagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatgagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccgtgctttccaggtccctaccaggggttatgcctaatcgtgcctaggctgttgtccccgttgtccctc

SEQ ID NO: 451906 - DNA, 1521 bp, Homo sapiens
  misc_feature (1291)..(1291): n is a, c, g, or t
  misc_feature (1294)..(1294): n is a, c, g, or t
  misc_feature (1296)..(1296): n is a, c, g, or t
  misc_feature (1300)..(1300): n is a, c, g, or t
  misc_feature (1308)..(1308): n is a, c, g, or t
acaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgcaaaaaaaaaanaananaaanaaaaaaanaaaccggggccctatctattctggggggcagcagaaaaacaacagagagtaaagaaaagacggagcaccagggcaccagaacccggtcccgagcccaccagccctatcgatgggcacacgagcgagcggaacactccgcgccgcccccacaacagggcaccgcgcattaaatgcacgacaaccaccggacacgcgctaaaaaccccgccgacc

SEQ ID NO: 451907 - DNA, 1095 bp, Homo sapiens
acaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggaaccccccttctcaggccggctcttgacccggggtgtccctttccttaatggccccttatttccccccggtta

SEQ ID NO: 451908 - DNA, 1529 bp, Homo sapiens
acaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccgccgtgagtggcccagccctggcccctactcccactgtcccgctggggacactcggtttatctttgaagtggggatagagccagtaccttcaatgtgggtttcaaaccggcttggacagagggacggacattctcctctgcagagtggggtctctggggggtctggggccttgcaggaggtgggcggggccaggaggctagggagggcaagaggggccagggctctgagccatactacctccttgcagagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 451909 - DNA, 1312 bp, Homo sapiens
  misc_feature (1082)..(1082): n is a, c, g, or t
  misc_feature (1085)..(1085): n is a, c, g, or t
  misc_feature (1087)..(1087): n is a, c, g, or t
  misc_feature (1091)..(1091): n is a, c, g, or t
  misc_feature (1099)..(1099): n is a, c, g, or t
acaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatcgggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgcaaaaaaaaaanaananaaanaaaaaaanaaaccggggccctatctattctggggggcagcagaaaaacaacagagagtaaagaaaagacggagcaccagggcaccagaacccggtcccgagcccaccagccctatcgatgggcacacgagcgagcggaacactccgcgccgcccccacaacagggcaccgcgcattaaatgcacgacaaccaccggacacgcgctaaaaaccccgccgacc

SEQ ID NO: 451910 - DNA, 753 bp, Homo sapiens
acaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggccctttcttggacatgggggaggggcacccaaaacccgaatttttacaccccgggggggtcaataccccctgatttggggggtggaagcctgggaagccctttggttccccctgaaaaccatgggagaaattggaagactttgggttggata

SEQ ID NO: 451911 - DNA, 1167 bp, Homo sapiens
acaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatgagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 451912 - DNA, 1432 bp, Homo sapiens
acaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgcagtgcgaacaacaagaagagaaagaagacgaaaataaaacaaagaaaaaaagaaagaagagaagaacaagaagaaaagaaaccaagaaaacacagggaggccggggacagaaagagcagcacccgcgaagggcgcagaaagcagaaagcaca

SEQ ID NO: 451913 - DNA, 974 bp, Homo sapiens
aaaactaggctaggtacgaggctgggtggtgtagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatgagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 451914 - DNA, 1081 bp, Homo sapiens
acaggtgcagggagcagtttctctccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatgagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccgtgctttccaggtccctaccaggggttatgcctaatcgtgcctaggctgttgtccccgttgtccctc

SEQ ID NO: 451915 - DNA, 1374 bp, Homo sapiens
  misc_feature (629)..(629): n is a, c, g, or t
ttaattcagaaatttaggtgatgctggttaaaaagtctgcctggtgtggggcctcgtccatgcactgtccctgttcagctgcatcccctctgttcccctagcttcagtttgtgctgacaatcatccagaccagctgcggggtcatctggccgtgcacattccctcttggttggttgtatttccagattggatacatgatttccctgattgctctcttcacaaacttctacattcaggtaaatctcacccttctctgggacttggaatctggggcctttaccaacaaaggccctcatctatttacttaatgggcatgtggagcccttgctgggtgacaggctctggcctctaatggagtcactatgacaagagcagcccctgcctctggggggctcacagctcactggaagacactagaatcctgttctagagcctgggtgaggaagtcttgggattcccctgggaaatggaaaactgtgcagcaggaccctatgttgcttccctctgacctgcagcagagacgtgagaggtgatttcaatcagaaatctctcagttcactaccctgaacgtcatggccaaatgaaatttcagaagagatttttatcacagtcctcagatatggagatcngcttttttgtcccagctttcttatacattcagtcttcaggtgtgaggattcggttcattcctaagcatatgatgtggtgatgtaggtctttgctcacagaaagatccatttagggcagataatttccagtggagcctgaccacgttgcagccactgctgattctcctgccatgcgtcaccccccagatgacatgtgtcctgcctttgttgccagtgcctggtagccataaggcctgctgatctgggcaaaacacggaggtcaggagcaagggcagaggctgcaagtcccgaggctcagacatttgtcctttcttcttctgtgcccacaagcacctgtgtgtggcatgttgagtttcagtggaagtcatatacttctgggcttcatagtttatggctgcactgtgggacatacaccagctacaaggaaggtgaaaggataggacccgatgaagctgaaatcacatttattctaactacttatagcagcatagcactttgttcatgaaggctgagatagtcgctgaggcagtgaggaacttttgaagacgaacaagggatgtgggtgtcaagagagctgctgccaggtgggaaagaccaatttggccacataacccctgtcatctgccatccagatactaaaaggcaaagcaaagtgtaaattgaattttctatgtgacattttaaatagtatttctgctgcagcctgtgattcagttaacttacctcaggctaagctcaaaaaaaa

SEQ ID NO: 451916 - DNA, 2850 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattattacctgtgcctgcattttacat

SEQ ID NO: 451917 - DNA, 3155 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagaatgaagtcagtttaattagactccaagatggagagttcaggactggagccaggggaagtgcacaggagtgactcctggccccagcactatgcacatttctgtgttcaagggacaaaaccacagcaagctgtcagatgattccctggtaaagagaagaaaaacactgtataaagtacagctgtgtgcatctgagtggatgtggggggttctgaacacattgtaatagaaggacttctgatcagcctgcatggatcctgcttgactggccatgactttagagagtagtagaagacagaaaagttaatacaccttctaatgaattaccatttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 451918 - DNA, 3057 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagaatgaagtcagtttaattagactccaagatggagagttcaggactggagccaggggaagtgcacaggagtgactcctggccccagcactatgcacatttctgtgttcaagggacaaaaccacagcaagctgtcagatgattccctggtaaagagaagaaaaacactgtataaagtacagctgtgtgcatctgagtggatgtggggggttctgaacacattgtaatagaagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 451919 - DNA, 2702 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 451920 - DNA, 2771 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagatgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 451921 - DNA, 2128 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgagtttgctatgcagaatagtattgaggatgtatgcccgtgggcgattatgatgaatactgcgccggtcaagcttcagggggtttggatgagaatggctaatttctctcggaccaatg

SEQ ID NO: 451922 - DNA, 979 bp, Homo sapiens
tgctggcggctgacctgtttccctctccctcctccctgcctaagaaaaggaataggggcaggagaggcccttcctataccagtatctcctctggatccgcctaggtcttcgctctcatgctactactcctcagtttgttaaatactgccctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 451923 - DNA, 2098 bp, Homo sapiens
  misc_feature (1353)..(1353): n is a, c, g, or t
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcaggtaaatctcacccttctctgggacttggaatctggggcctttaccaacaaaggccctcatctatttacttaatgggcatgtggagcccttgctgggtgacaggctctggcctctaatggagtcactatgacaagagcagcccctgcctctggggggctcacagctcactggaagacactagaatcctgttctagagcctgggtgaggaagtcttgggattcccctgggaaatggaaaactgtgcagcaggaccctatgttgcttccctctgacctgcagcagagacgtgagaggtgatttcaatcagaaatctctcagttcactaccctgaacgtcatggccaaatgaaatttcagaagagatttttatcacagtcctcagatatggagatcngcttttttgtcccagctttcttatacattcagtcttcaggtgtgaggattcggttcattcctaagcatatgatgtggtgatgtaggtctttgctcacagaaagatccatttagggcagataatttccagtggagcctgaccacgttgcagccactgctgattctcctgccatgcgtcaccccccagatgacatgtgtcctgcctttgttgccagtgcctggtagccataaggcctgctgatctgggcaaaacacggaggtcaggagcaagggcagaggctgcaagtcccgaggctcagacatttgtcctttcttcttctgtgcccacaagcacctgtgtgtggcatgttgagtttcagtggaagtcatatacttctgggcttcatagtttatggctgcactgtgggacatacaccagctacaaggaaggtgaaaggataggacccgatgaagctgaaatcacatttattctaactacttatagcagcatagcactttgttcatgaaggctgagatagtcgctgaggcagtgaggaacttttgaagacgaacaagggatgtgggtgtcaagagagctgctgccaggtgggaaagaccaatttggccacataacccctgtcatctgccatccagatactaaaaggcaaagcaaagtgtaaattgaattttctatgtgacattttaaatagtatttctgctgcagcctgtgattcagttaacttacctcaggctaagctcaaaaaaaa

SEQ ID NO: 451924 - DNA, 701 bp, Homo sapiens
ggcttatccactgaaaattttccttggataggaaaggacttagcactcaggcctgtgaatcaggaaatacaaagacctccaaaaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaatctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 451925 - DNA, 666 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgaggtatcagcagctctgtcctcagaatgggtcccccacttcacacagttgtaggatggctacagcagctccaagcagcacattcagaggaagaagaaaaaatgtttcatttgtgtggttttaagcataaagaagttgtttcccagagctctttgccagctgtcatccctcaaaactcactggccacaattgcttcacatgcccctgcctgaaccagccaccagagggggttaggaccaccacagattgactagatcctaaggattctctacctggggctggagttcgggtcaggtgcccgggaagcactgtgcggtgtgggaggatgaatatgtgccaatttggaaagatgagtatttgtgggaaaatgaataaagcaaagtgtaaatcagaggtttaagttaaaa

SEQ ID NO: 451926 - DNA, 745 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaaggcattatcccggtggttcccttcgtgggggtggggggttaaaccttaaaccctttttccctttccccccaaaaaaaaccttttcccaaatttaaaggggaaaaactttctcttaaatttggggggaaaccaaacctttttttttccctttttcctttttccaatccccgtggccggccaagaaacaaaccaccagatcacggtcctgcacgtctacc

SEQ ID NO: 451927 - DNA, 570 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgaggtatcagcagctctgtcctcagaatgggtcccccacttcacacagttgtaggatggctacagcagctccaagcagcacattcagaggaagaagaaaaaatgtttcatttgtgtggttttaagcataaagaagttgtttcccagagctctttgccagctgtcatccctcaaaactcactggccacaattgcttcacatgcccgggaagcactgtgcggtgtgggaggatgaatatgtgccaatttggaaagatgagtatttgtgggaaaatgaataaagcaaagtgtaaatcagaggtttaagttaaaa

SEQ ID NO: 451928 - DNA, 2827 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 451929 - DNA, 2962 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagaatgaagtcagtttaattagactccaagatggagagttcaggactggagccaggggaagtgcacaggagtgactcctggccccagcactatgcacatttctgtgttcaagggacaaaaccacagcaagctgtcagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 451930 - DNA, 2153 bp, Homo sapiens
tcggatctagaggacccagcggccgccttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 451931 - DNA, 3018 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattaaaaaaaaaacaaacaaaaaaaatgtttgggcgcgccgggcccgaaaaagtttaaaactctgtttggcgcgggcccaggttagcgaaaggccacgcgttcaaacaccggccaacatggtggttccccaaaaaccgcggccggtcttgacccaggtgggcttgggctatcaagcaggacatacacccgggact

SEQ ID NO: 451932 - DNA, 1444 bp, Homo sapiens
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagacattgacataaagtagaacttgcttccaatacgtcttaaaggttaaatgttacacacagcgtacagtcaatgcaaggaggcctgcacacagggaacttctgtctaggactgcggccggtaagaccttcctgtgtggaccacagcactgctcaggaaagctgcctgcaggtgaataagtgaatgtgaaattaagcgagactctctgcaaccgtattcactatatcacactttcatttggcctcttttgcattatttcctaatgtttggagaatacatttgagaaagaatgttaca

SEQ ID NO: 451933 - DNA, 2044 bp, Homo sapiens
  misc_feature (1353)..(1353): n is a, c, g, or t
ggccggcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcaggtaaatctcacccttctctgggacttggaatctggggcctttaccaacaaaggccctcatctatttacttaatgggcatgtggagcccttgctgggtgacaggctctggcctctaatggagtcactatgacaagagcagcccctgcctctggggggctcacagctcactggaagacactagaatcctgttctagagcctgggtgaggaagtcttgggattcccctgggaaatggaaaactgtgcagcaggaccctatgttgcttccctctgacctgcagcagagacgtgagaggtgatttcaatcagaaatctctcagttcactaccctgaacgtcatggccaaatgaaatttcagaagagatttttatcacagtcctcagatatggagatcngcttttttgtcccagctttcttatacattcagtcttcaggtgtgaggattcggttcattcctaagcatatgatgtggtgatgtaggtctttgctcacagaaagatccatttagggcagataatttccagtggagcctgaccacgttgcagccactgctgattctcctgccatgcgtcaccccccagatgacatgtgtcctgcctttgttgccagtgcctggtagccataaggcctgctgatctgggctttgtcctttcttcttctgtgcccacaagcacctgtgtgtggcatgttgagtttcagtggaagtcatatacttctgggcttcatagtttatggctgcactgtgggacatacaccagctacaaggaaggtgaaaggataggacccgatgaagctgaaatcacatttattctaactacttatagcagcatagcactttgttcatgaaggctgagatagtcgctgaggcagtgaggaacttttgaagacgaacaagggatgtgggtgtcaagagagctgctgccaggtgggaaagaccaatttggccacataacccctgtcatctgccatccagatactaaaaggcaaagcaaagtgtaaattgaattttctatgtgacattttaaatagtatttctgctgcagcctgtgattcagttaacttacctcaggctaagctcaaaaaaaa

SEQ ID NO: 451934 - DNA, 364 bp, Homo sapiens
  misc_feature (20)..(20): n is a, c, g, or t
gactctagagcatccctttnatgtcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcccaaatctgtgtttgctttctgcttgctacatttgtctcccttacttttcttgagctaaagacaggctttttccaccggcatcatcactgctatcatcattaacagcgtaattatacaagcatatttaatgctgattgcagtgatggtcatgcacaaggatccgtaga

SEQ ID NO: 451935 - DNA, 500 bp, Homo sapiens
ggggtaatacatatggtaattgtattacatattaaattaaactcagcatttaatatgtaatacatatggtaattgtagggtaatacccacaacaactgtagtttcttacttggccaagagaatgcttatttaagtgttagacttccattctggcaaaatcttgccatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttc

SEQ ID NO: 451936 - DNA, 2499 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcccaaatctgtgtttgctttctgcttgctacatttgtctcccttacttttcttgagctaaagacaggctttttccaccggcatcatcactgctatcatcattaacagcgtaattatacaagcatatttaatgctgattgcagtgatggtcatgcacaaggatccgtaga

SEQ ID NO: 451937 - DNA, 3269 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaatgtgtcctgtgcttttagatttttaaattccataatatacattcttaattttcaactca

SEQ ID NO: 451938 - DNA, 2667 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttc

SEQ ID NO: 451939 - DNA, 2409 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcccaaatctgtgtttgctttctgcttgctacatttgtctcccttacttttcttgagctaaagacaggctttttccaccggcatcatcactgctatcatcattaacagcgtaattatacaagcatatttaatgctgattgcagtgatggtcatgcacaaggatccgtaga

SEQ ID NO: 451940 - DNA, 3164 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtattctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaat

SEQ ID NO: 451941 - DNA, 2374 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcccaaatctgtgtttgctttctgcttgctacatttgtctcccttacttttcttgagctaaagacaggctttttccaccggcatcatcactgctatcatcattaacagcgtaattatacaagcatatttaatgctgattgcagtgatggtcatgcacaaggatccgtaga

SEQ ID NO: 451942 - DNA, 2437 bp, Homo sapiens
  misc_feature (2339)..(2339): n is a, c, g, or t
  misc_feature (2354)..(2354): n is a, c, g, or t
  misc_feature (2397)..(2397): n is a, c, g, or t
  misc_feature (2432)..(2432): n is a, c, g, or t
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcctatccanaaaaaacatttgggnaaaaaaaggggaattccccttttggggtggttttggggtcctncctacctttaaaaaaaaaaaacccttatttggccnaggtt

SEQ ID NO: 451943 - DNA, 2442 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcctctgcccaatctgtgttgcttctgctgctacattgtctcctactttctgagctaagacagcttttcccgaatcatccgctatcatcatacccgtatatacgatattatag

SEQ ID NO: 451944 - DNA, 1293 bp, Homo sapiens
gtaagcgtaatgtccttcagcaagggctttatttatcagaaggacattacgcttgaccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcccaaatctgtgtttgctttctgcttgctacatttgtctcccttacttttcttgagctaaagacaggctttttccaccggcatcatcactgctatcatcattaacagcgtaattatacaagcatatttaatgctgattgcagtgatggtcatgcacaaggatccgtaga

SEQ ID NO: 451945 - DNA, 1079 bp, Homo sapiens
agtgtttaaagtttgtaattcctagctaggaaaacattatctgaatgaataccctaatggcaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcccaaatctgtgtttgctttctgcttgctacatttgtctcccttacttttcttgagctaaagacaggctttttccaccggcatcatcactgctatcatcattaacagcgtaattatacaagcatatttaatgctgattgcagtgatggtcatgcacaaggatccgtaga

SEQ ID NO: 451946 - DNA, 585 bp, Homo sapiens
atcattaacagcgtaattatcttgcatatttaatgctgagtttaatttaaggtgtattacatatgggaattgtagggccatacccacaacaactgcagtttcttacttggccaagagaatgcttatttaagtgttagacttccattctgtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcccaaatctgtgtttgctttctgcttgctacatttgtctcccttacttttcttgagctaaagacaggctttttccaccggcatcatcactgctatcatcattaacagcgtaattatacaagcatatttaatgctgattgcagtgatggtcatgcacaaggatccgtaga

SEQ ID NO: 451947 - DNA, 999 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagcacatgagatagttggaaggccttccaacatctcattactctactacctacctacaagcgatactgataactctactcctgcttatcagcgagcgt

SEQ ID NO: 451948 - DNA, 523 bp, Homo sapiens
gtttcaatttaaacactagcactttaaattgaaacactggtagaaacgtagcagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaat

SEQ ID NO: 451949 - DNA, 415 bp, Homo sapiens
aaaaaaaaaaaaaaaaaaaaaaaaaaaaaaaaaaaaaaaaaaaaaaaaaaaaaatgggtagtcacagacgtctgtgacttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaat

SEQ ID NO: 451950 - DNA, 278 bp, Homo sapiens
tgtcttcgtcaaattacagaagccaaatgctgccatccgagactgtgacagagccattgaaataaatcctgattcagctcagccttacaagtggcgggggaaagcacacaggtaaataattgaatttaattattttcagaactctttacatttaaatctgatgttttaagatgctttgtttaaacaaaaacacaaaagttcctaatgacttaattttcaaattagtgtgtacttagtatcaagaagtgagatagcttgtagacagctgcttaaaaggt

SEQ ID NO: 451951 - DNA, 288 bp, Homo sapiens
gcggccgcctactactactactactgctcgaattcaagcttctaacgatgtacggggacatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaat

SEQ ID NO: 451952 - DNA, 3211 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaat

SEQ ID NO: 451953 - DNA, 2445 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaatacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcccaaatctgtgtttgctttctgcttgctacatttgtctcccttacttttcttgagctaaagacaggctttttccaccggcatcatcactgctatcatcattaacagcgtaattatacaagcatatttaatgctgattgcagtgatggtcatgcacaaggatccgtaga

SEQ ID NO: 451954 - DNA, 3158 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccatcttgccttatcagaagacattggaaagagggattccctttggtgtttggtcttctacttagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaat

SEQ ID NO: 451955 - DNA, 2396 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacaggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcccaaatctgtgtttgctttctgcttgctacatttgtctcccttacttttcttgagctaaagacaggctttttccaccggcatcatcactgctatcatcattaacagcgtaattatacaagcatatttaatgctgattgcagtgatggtcatgcacaaggatccgtaga

SEQ ID NO: 451956 - DNA, 2585 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgcctttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttc

SEQ ID NO: 451957 - DNA, 1297 bp, Homo sapiens
accgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaag

SEQ ID NO: 451958 - DNA, 1044 bp, Homo sapiens
ggggtaatacatatggtaattgtattacatattaaattaaactcagcatttaatatgtaatacatatggtaattgtagggtaatacccacaacaactgtagtttcttacttggccaagagaatgcttatttaagtgttagacttccattctggcaaaatcttgccatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaat

SEQ ID NO: 451959 - DNA, 2457 bp, Homo sapiens
ggcccggcccgccggcgacgtcacgcggccgttacggcgctcaggcgtctcgacgcgcgcgatttaaaaccagctcaggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaatattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 451960 - DNA, 2781 bp, Homo sapiens
ggcccggcccgccggcgacgtcacgcggccgttacggcgctcaggcgtctcgacgcgcgcgatttaaaaccagctcaggagacgccaaggaaagatgggacctcccggcccagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 451961 - DNA, 2723 bp, Homo sapiens
ggacgcgtgggcggacggcgtgggtcgacccacgcgtcgggacctcccggcccagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 451962 - DNA, 2742 bp, Homo sapiens
ggcccggcccgccggcgacgtcacgcggccgttacggcgctcaggcgtctcgacgcgcgcgatttaaaaccagctcaggagacgccaaggaaagatgggacctcccggcccagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 451963 - DNA, 1950 bp, Homo sapiens
ggcccggcccgccggcgacgtcacgcggccgttacggcgctcaggcgtctcgacgcgcgcgatttaaaaccagctcaggagacgccaaggaaagatgggacctcccggcccagagacgcgaggacacccccacagtgcctcctctccttcagagcgtgtgttcccgatgcccatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 451964 - DNA, 2127 bp, Homo sapiens
ggcccggcccgccggcgacgtcacgcggccgttacggcgctcaggcgtctcgacgcgcgcgatttaaaaccagctcaggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggtcagatgctcttgcctgttctctaggtgcccagc

SEQ ID NO: 451965 - DNA, 1570 bp, Homo sapiens
ctgaaatttaaggtctgtgtcggccctggtttagacaagtttaagaatgaatgaccacggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 451966 - DNA, 252 bp, Homo sapiens
tggcaattatggttatcgaattccttttaactcccgctcaaaaggtcttaggttgataacagacacctctctaatagggtttacgtgaaacaggatgataactagaggcacctagaagttcatcgtagtgtaactcactgagtgaaccatcagatggtctcttcttgctttgtaaacatggagtctatttcaagggtgtttctgagctcctctgcagcgtccaccaaactcgaagagctgtttcttgcccag

SEQ ID NO: 451967 - DNA, 2814 bp, Homo sapiens
ggcccggcccgccggcgacgtcacgcggccgttacggcgctcaggcgtctcgacgcgcgcgatttaaaaccagctcaggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 451968 - DNA, 4506 bp, Homo sapiens
ggcccggcccgccggcgacgtcacgcggccgttacggcgctcaggcgtctcgacgcgcgcgatttaaaaccagctcaggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaatatttgagtgtccactagatgagtatcagacctagtccttacccttagggggatgcagtcctggttgttatccaggatacacacctgtcagtataaggcagaagatgcctaagggccaagatggtttgcctcggaggagaatggaagagagagattgctgactggacattcagatgcaagactgggtcctgcttaaatcccaggattctgctggagggagctgatagtgatacttgtcccttctgtacattgcttcatgtagccttctcagcatccctaggagaaacttactattgtgactctcatgttggaggaggaaacggacacccaaggtagaggaacttgcaaaagggcagccggcaaactgtcaggggtggcctgagcctggcaatctgcctccagagtctgctctcggccattgtgctatgtgctacctggataggtcatacaggctcagcagtgggtggagagcagtgctcagatttgtccatctccacagaatgcagcacacacacaaatgtacaagttcttcccctaacctcagaggaataggggaattaactttgcttgcaatttggaacaatattatagatgttgatccaagtagttctgttactggctggtcctggatctctgccagaacacccgtcatcattgactggctaaatagagatcttggatataggccagaagcagtgaagtatataattggaaattggctcctgataataacttcctttttagcccaaaaccacaccaaacaaaaataatcccctccccacaggaatatgctttccaaattgtgtccaaaacattacctgctctgttatattgagaaggttagagacttcagagcatgcttagaaaaagcagtggtgccacaggtgagactccacactctgtcttgctggggctgaagcctccatcactttcccaggccaggttagtgctgggcttcttgctttccttctattcctgagagtagaactggctaagcccattccttccctcagtcagccccacttctctatagtgggttctgggggtggggggctgaattaccagtaaaactagaaagattgggaccaagtgcagtggcccacacctgtaaatcctagcgctttgaaaggaagaggcaggaggattgcttgaagtcaggagttcaagaccagcctgggcaaaatagaaccccatctttaaaaaaaaagtttaaaaattagccaggtacggaggtgtgtgcctgtaatcccagctactcagaaggctgaggtgggataatcacttgagcccaggagtttgaggctgcagtgagctgtgatcacactactgcattccagccaggacaacagagtgagatcctatctcttaaacaaaaaaaaaaactggcgagttcaataccaacttctacaatgaaatccccttccccccacaaccctgcttctcctaagtttccctcattacatggttgctgtgggctatgtgtgctgtggtctgaatgtttgtgtctaaaattcacatgttggtattaagagatagggcctttgggaggtgattaggttatgagggcagatccctcgtgaatgggattagtgctcttataaaagaggcctgaggaagcttgttcgttcctcttgcccttctgccatgtaaggatgcaatgagaaggcaccatctgtgagcaaggagcccctcac

SEQ ID NO: 451969 - DNA, 3114 bp, Homo sapiens
ggcccggcccgccggcgacgtcacgcggccgttacggcgctcaggcgtctcgacgcgcgcgatttaaaaccagctcaggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaataaaaaaaaaaaaaaaaaaaaaaaaaaaaaaaaggggggggggggaaaaatttccccgggggggccattacgcgggtcccccagtctttgttggtcacaagggggcccctataggggaggccgataataaatacacagaggcccgtgggcccgcgttttaaaaaaccgtggcgcgggaaaacagggccccccggggcacctgtgggaagagacccttactccgtggcgggggcacatcagggcacaatctcccaccagaaatttaagacccaggggaaactttaacatttacaggggaacag

SEQ ID NO: 451970 - DNA, 2655 bp, Homo sapiens
gctttttaagccaatggcatttgttagtgacttatagaaggagaccagcagcaaggatacacgtccagatgtattataaaaaagccatttgacacagtgtacacttgccaccacatactgtcttctggagcagtatatgtttatctcctgactataaccagcctttcttttgaaccgggattttatctgctcaattagaaagccacttttgttgggtgcggtggttcacaactgtagtcccagtactttgggaggccaaggtgggtggatcacttaaggtcaggagttcaagaccagcctggctaatatgatgaaaccccgtctctactaaaaatacaaaaattagccagatgtagtggtgcgtacctgtagtcccactactctggaggctgaggcccaagaatcgcttgagcccgggaggcagaggttgcagtgagcccaatatcatgccactgcactccagcctgggcggcagagcaagactccatctccaaaaaaaaaaaaaaaaaacaaaaacaaaccacttttgaccatgagtggagatatttcagtccagtgtatatacctgctaatgagtggggccaaatgcatgagaatttatctttcccttggctacatgccgtaaatcttcagtttcttctctctctgtgttcagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 451971 - DNA, 1859 bp, Homo sapiens
agattttgaaattgactttgaagatgatattgactttgatgtatattttagaaaaacaaaggctgctactattctgaccaagtccactttggagaaccagaattggagagctaccacccttcctacagatttcaactacaatctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 451972 - DNA, 1157 bp, Homo sapiens
ggcccggcccgccggcgacgtcacgcggccgttacggcgctcaggcgtctcgacgcgcgcgatttaaaaccagctcaggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtctcgctcctgctagacacagctcaagaagcactgactttgcttgcatcctggtgat
